United States Patent 9,487,797 (GENOMIC PLANT SEQUENCES AND USES THEREOF) - sequence listing, part 109

SEQ ID NO: 108844 - DNA, 1401 bp, Oryza sativa
tgctattgatttcccaaagctgaagcacgtccacctgcatgagcttcccagcttgaaagggatatgtgaggcaaaaataatgtcagctcccatgctggaggccatcatgatcaggggctgctgtagtcttagacacctgcctgacgtccaaggattgcatgaaccaagacccatagtatactgtgagaaggattggtgggataacctagtgtggcctcagaaagaaggtggctatgatcagtcattgctctacaagcggcagtcagcgcaatactataagaaggccttgcccaaaggctctattctcaggtcaaatctatccacatacctctataagccaataagcaaaaaatattctatagatttgcatggctagtataacagaattccatttcaagtttgtttccgttactgcaacactgctttattatattttcctctttattttgttgatcatgctgattccatcattggttgatttttccaaatgaagtttttttttttttgagaaaccccaaatgaagttatggaggacagtggtgtatagtgggaaataaagtaaaggtcctatttgaaatttagggatttattggaaatgaattgcatggctagcaataccactaggcatgcgattcttggttgtaacaggttggtaagagaagaatacaagtgcaatttgtaaaatgtttagtgttaattttccttgcgtggttttctccggaccttgggaactagaaatgtttttagtgttaattgagaggtaacatagtgaggtatatatatgtgtgtgcgtgtatgtgtatgtatgtatgtacatgatgggagatcatagatttggatgaacaattttgagaaagggggagagactaggttaattcatcttcattgcttgcttactagtaatagttatacatgctagcactctacctttttgtacagattacttggcttggccccacaagataaaactctatctacaatgtaatttttatctttaatacatgtgaatatatctgagggaaaccaaattagcaaggaaacaaactattcttatctgtattttccaactaataggaaaccagcaggcccacagtacccaggccctacattttaattggcactgttcaggattcaggaatagttatttaacctctcaatacttcccctagaaaaactatttttgcactcttttgaagttccagcactgtaaaatatctgatgaaaagtcgcaccaaaatattagttcggcaaaaaaaaaaatgataagactgtttgaagctaagtggctaacttttgagtgctggctataatggcggcctgctgtcatttggtactccttgtttatctgcatagtaattcagcaacaattatgtgcgcacacccagatggaggtgtagaaaa

SEQ ID NO: 108845 - DNA, 694 bp, Oryza sativa
gtattgcttgggtaactttttctaagctattcgttggctttacactacatactatacaatattcattcggtaagaaattaactatgatctgacttatcattcaaaagaaaagtatactttgttttggaaacaggtaagtgtaaattaaaagtaagtagtttttattcaaatggaatgtttacgggctctcttttttaacaaaatttttaaaactattattgcaaataattatgtttcagttgttccatgaagttaacaatccctcttactgattcatattgacataattcgaatacttatctagcccctgcttccctacgatgtgttagacccatagtatttttttaagaaaaaaacaaagtgaatatcaagtttaatataacttttaaaccaattatatatttctaccttagtgggttatgtcttttgtgtgcatgatgtagtgaaactaataatgccacctgaagggtattagcatctaaacactaaaaaatgacgcaatggatatggtaacgggtgttccaattttggtgaaaaggaagaaccaattttttctaagaccttataagattttccctaattggtccgctttactcttattggcatttcctattttttgttttattttatgcaagcattttttttaagttcaaatgacgtgagatgataaataaagatgttacacctaaggtgc

SEQ ID NO: 108846 - DNA, 1717 bp, Oryza sativa
acttgcaaaagaactttttatttgcaaaacttgtaacatgttacatgtcatcaactatcatgaagtaaacctgtttgagtcaaacatcctcctattctggacaatcgaaaagagcaaaatcttttgctaccacctaatatcacccttctacgctctagcagtacatggttgtggcaatgggcgtcacataatcttagtagcattatacatatgttcttaccactattttacatcttcaaagctacactgccttttcgaagaaaagaaaataaactacgctaccaacattaacttgaatagatgcgctctgcacaaaacaaagaaaagcctttttcagcctaaggggcattgttgggctctcttaagaggacactctcaaacaaatccaccaagattcacaacataattcacacctcgattcatcccaagccagccaaaaaaataaataaatccccacaatcccaatagactgaccctctaaatcccctaagtagatgagacgtacgcaccaaattaaccaaatgcaagattctagttgtacaagagtaatttattcggcactaaatcgatacccacatatttcactgcaaattctaccctacctgacgcattcccgcaggcaatcaattttttgagaaaattaaaaacaaatgggtgaaacatcaactgcaacaatcatgctgaacccagaccttgtggaagcgcgtcgggtgccgcgggagaccaccggtccggcggccgcggccggcacccagaacctccccataggctgtagccgctgaaacccagtaccctggacggccactggcgcgccgcggccgtgcgtggtgggtagggtcccagactcccagatggatacgaggaaaagcagaaaatagccaaaccgcaggcgcatgaagaagacaaccgatgtgtggttagtttcttataacctccgtcccatattttgggaaagatggagtactattttttaacctcttcaatttaaaatttaaaataaagtcgtatgtcgttacgttataacggataaaacggaaaagtcccatataagcatggatgagctaggatgatgattgaaaataaaatgttggatctggtggttacgtatattatatgtacggatgcactgcatatggtgggaggaggacatggaagtaaaaccactccgcttttaagatggtatagaaaaataaagctttttttaccgcatcatccgaaatggcatggcatgtaaatgtttgtgaggcacacaaggtagctctctttgcataggaacatcgttttgtttggatgcccctcttctagcattgggttttgattttaaaataacagtttagattatttgttttcaaaattatatcagagaaaagtttagaaaataagaaattacggttgggaatacgttttggcaaaacaaatcacataaaaaattagtaatataaatgaaattgtggttatatagtaattcagtaaatcaagtgtgttgtgttaatttaccaaattattttagaacatttttactactaataagttgcactattaaagaaaatttttactactaaattaccaaattattttagaacatttttactactaataagttgcactattaaagaaaagttttactactaatttaccatattattttagaacatttttactactaatgacctaatatcagaagccatgttaatattgaaagccatattaggtcatg

SEQ ID NO: 108847 - DNA, 1103 bp, Oryza sativa
tcccatggatggacggcaagggtgcggttgtagcccgattggccgccgcaagaggtgccagatgtggtgacgttgtactgtccttagcacggatggacgagctacactcgttgcgccatatcaccatcaccttcgccggagcactcaccggcgacgccgctgtatggtccaccaccggctgaaccgccgcggagcgccgcccttctacatggcagcaggtggctctagcaaacgtgcagcccctccaccggcccctccgttccctggcctctcgaccgcaaccgcggcggcaaacgcgcgccccggcctctaccgcatcatcatgcccaggcatgtccctgccgagttgagcggcggcgacaaggccagctgtcccccgcccttgagtgagggggaggcctgagcatggggagggatgaggtccaggaggtcagggcagaccggcggcggcgtcggtggcaacccaacacggcggcggctgcgggcggtgacaatgaccagacgacagaccgtagtgtgctgccggcgataccatgctacaggctacaggctacggctgctcgctagggttggtctctatctccctctccctctccgagacaccgtgcctgccgccggcgacttgacgagtccgaccactggcgtcagttgcgccgcctgagcgggctgaggcccagctaggtagttaacagcccatccgcccttcgctgctcactaggaccgtgtaattaggctaaggccacatttagcataactttacatatccacgataaatttaaagtttatatggatttaaaattttaaatatttaaagtttatatggatttaaaattctaaatttaactaaaatggaaataaaataatttatattagtattgttaacgtaacagtaggtctatatccataaatttgtgggagctaggaatatccaacttcaaatatttatgtatctagagctttgtcgaagaggatttaaggtgtgtttgaatcactcgtttttgatccatacgttttctaagttagtaaatgtgcaatttttttttgaaaaatatagaaaaattatcttttaaaaaaataatattaacctattttttaaatttaca

SEQ ID NO: 108848 - DNA, 1032 bp, Oryza sativa
cagaggttgataaggttgcagagtaaactacgaggccccaatgtctcctaccggtaacgaattactgctgaaatcgcgaccatctcgtgccatcaaacagtcgagaaattttttttaaaaaaggcagagacacgtgcagctagacgacgtgattaagctctggcaattgatacgtgcaaacgagtaggtgaaccaaaccagccaattcggcgtattggacaggctgatggccataaaagcatacattttagagtaaattttataaaactacaaatgaattcaccaaactatcacaaaactacatatatagaaatatgtatcacaaaactacatatttaaccccaaatttatcgcaaaattatatgtttaggatatcgtatcccaaaactacatatttagtgaagaagtcatagaaaactacatcttttggagtttatatccatatcacaattgagattacaaaagtcttagttttatgataaaactggttttaaatacgtagttttctgatacgataccttaaatctgtagtttcatgatatgcatttttaaaactgtagttttcagatagattgattaaagtacctatagttttgtgaaatttactctatattttataatttgagggaattagacagttgacaagttgagttatatgcttctgattttttattcaaaatgtttttttaagaaattgagaccatacagatagtttctccaagcattgttcaaaaggcatttacaatctaatcttttgaggcgcctaaaaaaaacttatatttataggactagtttattatgttgtagatattgttgaatatgtgctagaaatgtctaataaggtagtaactacaaaattaaactaacgcataccaacagaaattgttaggagaaaactattaaatataaaattaaattcatttcctctcacttctggttcattgatggttatagatacttgcacgggtacccctaatgggcgatcgatcgccgtgcggatggggtagcgatcagattcgctccccacctccc

SEQ ID NO: 108849 - DNA, 638 bp, Oryza sativa
gcacatgtccactcccatcttttgcaacaatgagatagaacaatcagatggaaaggaatcagaatgaatatcatcataggcacttttagtaaaatcagactctttaatgctactatcatcaaagatttttgctatacctgcaagcctgcaagctctttcaatttctttgcagatttaccccttggcttgccaatgtccattctgggatccacttgcagttctgcttcctccttattctgctgcaaccttgcactctgcctcctgtaagggttataaagcaaagttttgacatctcttttcttaattggagccttaggtaacacaggaagagctggtgcttcacaaactgggctgaagggaggctgaatagacaagggcatgacatcaagtacttccatagcagcttgggtctaggcctccagggggccaacatcagactttgttgaatccggagcccaaacacttgtctcttgacccactaagggagaaaaatcaaacattgtctttttgggcaaaacaagagcagtaaaaggattgaccacatctatggcagcaggaacagaactagaagcaagaaattggtgcatggttcccttttctttgcacaagaggtcaatcttctcattcaggccagacat

SEQ ID NO: 108850 - DNA, 2174 bp, Oryza sativa
gtaaaagggttaacccaggagtgatatggttggaaggacaagcccttataagttggttccactcttgctaaactagcaaggtggtactaaacgagcgcacacaacactcataggtcacaaaggtctcatcctaattgggccaggatatcacactgggtcgccgtcaggtaggaccactgttgggcccatcttcaaccttcgcaggcaaagccagagggcgtaaccgccgccccgtgcgccccgtccacctcgcggcgcccactttgcacatgtcgccctcttccacgcccccgcaccccactctccccacgcttcgtgcttgtggagggcgtggtattcgattttcgaatcccggccacatctctctctctcctctcccacatccgctacaaaatccaccccctaccggccaagtctgagctcccaccgctatataaacgatcctcgtgatcccctcctccctttccctcttctgccgctcgttcccgtctttctcgaagtggttgtagaggttcaagtagcgcggagcaaggcaagccatgcatccctcattgaacatattatacctatattgcaaatgtctcgctttcttattttataatgtcagaattatccgttataacataagggtatatggttttattttaaattttaaattgaaaaggttaaaaaaaataataagaaactaaccactccagcttgtgtggcaacttgagagaagaggattgagattttagacatcaattctagaaattgatggtcagattaacatgggaatttgatttttagtcccaatcttttgtttgttagaggtggtaaaatttcattgagaatttagttagagactagataaatcttaaatgaaaatagatggttaagttttgtttaggtaaattaaaagaggaatttcctccgaattaccacccatgcccacgtatattttgaaacagtaaatttttaatggcatgattataattaaccctattaaaaatgtcactcaattccctatccccgtcttacgaaaaactctcgtctcccctaatcaaactgaacattttatagccacatcccacaactccccctaacctaaggaccgttcgtgcgcgttcggctattttctgcccttcctcgtatccatctgcgacattacccaccgcgcacggcggcgacacggcagtggccggccggggtactgggcttcagcggctacagcctatgggagtttctgggcgctggccgcggccgccggaccggtggtctcctgacgcgcttccacaaggtccgggtgccatatgattgttgcaattgatgttttcacccattttttttttctcaaaatattaattgcgcgtcaggtagggtagaattcgctatgtgggaatcgatttaatgccgaataaattactcttgtacaagtagaatcgcatttggttaatttggtgcgtcgtctcatctactgaggggatttagagggtcagcctaacgggattgtggaggatttgatttttctttttgttgttggcatacgatgaatcgaggtgctagttttatgttcgtggatttgtttgagtgtgtcctcttaagagagcctaacaatgcctattaactgaagatagacttttgcttttatgcagaatttatctagctaagtcaatattggtagtgaagtttattttcccttttttccctcctggaaaatgcaagtgtagttttgaagatgtggattgtggaatatgctggttgctagaacagttttttgccacattttggttgtcaataagagaagtttgtcccttgtgatgagaacaaacatatagcccttagagaatgaaatttgtagctctaaaaaaaaaagaacgaaatttgtcagtcttgatcaccttggaaatttccatactagactgaataaatccctactgttcttcgtgatactttgagtctacagatatatggcacagtgcagtttcctggtagatgtcacatgaagtaaaaacgttgaataccataagtccagaacttgtgaggctgaggctgtacttctcaaatgcaattactacctgtcacgccctaaaaatcgcctaaattaaaaatgcatattttaaattatttttagaaattattttaaaagcctacaagctaaaccctaattttctaggaaaattttcaacataaaa

SEQ ID NO: 108851 - DNA, 750 bp, Oryza sativa
aaatatggccatatgacttcttgtataaaattaaaagaatacattcatcatcgtgggtggtatctatatttcaacaagatgcatgctaaacggaggaatctcagtacattagtactatctaattaaaggatgattaatcatctgagtcagcacatgatgcattaaatcttgttgacagaaggtgccatttacgcccgccgacaggttgctatttattttgtgttctagtaagtggtaaagaaaaggatgaagtttctcaaattctataaagtatatatatatattttttagaaacatagtacaaacgcaagcactcacaacgcacgcacactaactcctatggacgcacatacgcacaccctacccctttgagcacttccggaagacttgctggcatatcttgagaatgacgaagccaccatgggtgccatgctgttaacggttacatcacctaccactaaaagaataattagccgtaaatgcgagtaccgtggcaaatctaggatttgaacccgggttggctagttccaccacaaggaacctaaccagttgagctatgctcacttcgcatatgatagatatagtgagacactgaccgtactcgagtatattgaagatctatatttcggcataatttaatcgagaataacgtgagaataaatatgaaaactatggaaaagagtaagctattgttaatcacaaccttaccagcagagattatagcatcaagtaacatgttcaacactagag

SEQ ID NO: 108852 - DNA, 1149 bp, Oryza sativa
ccccgtgcagatactctagaggatgtagttccgaaggcctgctcgtccaaaagacccgcgcgcgtaggattttcgaattggggataaacaagaagaaagaagagaaatgggggttgaaaaaaataaaatccccaaaattatggaaaataatatcagaagaaaaatcattttaaaaaattaaaattcagcgggatatgcatttgttcgatcctgagtggttttatgtaattaactttgacttttttttttgcgaggcagcaccaattaggtatttcgacattttttttgcgagaccccattgttacaatgaaaaaagaaattaaatatctatcagcaaaaagaaaaataagatgcactgtatcttggattaccgcaggagatacgagtagatgagtagtacagccgcagagctaaccaactcagacatgcacaaaagtaaataatatggatccatatcttttaaacatgttgcttgaaagaaattgtacaaatttgacgcactcggacaagagacggtgggtttcctctggcatataaacaacatcacgtttgtactgtgtttttttttaaaatatatataaatagacaggaaactatcaaagagcggttgtagtgaaccgacccttggtgtgggtatcatgagtcgactttccaagttttctatacctttaataatagggccaattacacaaatgccactagggtttaccgtatttgtcattctgccactggtttttggtcaattggtagaatgccactggtttcacagttgggcacgccaaaatggcactctgtcgttaggatcaaataattctgttagtcaacacgtttgactggggtaattaccattctgcccttgttctctaggacgcagctacaactccctactcatcagaaaccgccgtcgacgcccatgaatggatcgatctagggttcatattactctgtctcaaaatgtagctatttctagcacaataccttgtcccaaaatgaaactatttatccacctacctcctcatctcgaccaatcacaaccattctcctccacctactttttcttttcaaccaatcacacatttcctcctatcattctcacctaatttcttatattttgggacgaaggaaacttcctccaatcagtctcaccta

SEQ ID NO: 108853 - DNA, 675 bp, Oryza sativa
ccatgccaacacagccaacagagccaatataatcagcccaagccagccaccttgcttgacagcataaggcgttgataggacccccacaccacacaggacattcactcctgtatatcacagaattgaaatagagaatcatattgctggattgacatatactgtaaattttaacagagtaattgatcttctcagttctcacacagacctggaatttcaactgtaacagatgaactgaggctgcaaatactatatgagattcaacttgtactagacattaatatattcaaaacctagagaaactaattcagcagtgaaactgtgttcttctgtaaggaaaatgaatttttgtatggtgtttggtataattacagtctgaaattacactaagcagatggtaggatttaagtgtacttacactctgaaagtctgtttaatagaaacactttcatattcatgtttgcaatgaggtgtttcctgagaatggaaagtcttgtatatggaaaaaaatatccaaattgttctataataataaagaatgtctcatcttttaagaagaatataaggcttatccttgtttttctaagttatttaggtttagtaaataaaattgttctattgatttagaaaaaacactaaatccatactcatgtcacataatcccttggttaaaatatt

SEQ ID NO: 108854 - DNA, 722 bp, Oryza sativa
gggcataagtatatattaatgtgataggtcagttggaatgggaagtttactttgatttggtaaaagagtctcagtttagatctctagaggtgtttgcatcaaagttagttcgtaccgtagaaaatttggatctaaacaaatctccttcttatcattacgttgagaagaattttgtgacatattattctcgccgtggagggggtgcaagtaagagtgagttggtacgagaagacttggagggtgaaggagagaagaagagacctttgcttggaaatgatttatgggaggcaggaccatcaaagagacattgcggtactgatgatgtggatgcagcgagggtgatgaaaagggagttagtacaagaggggcttgatctaagtgaacatttgtcggcgagtattcattggtcgtcgtacggagtcaaccctgaatacccgacagaagtagcaggccaatatgtgaatccagatgattacttttatgtcgaattgagtggtggtcacgattctgtctcagtagaagtcaatagagatgatgttgacgaggaggcaagtgttgagcaatatgatgttgaatttgctgaagactctgatgatgaccgtccattccctccacttactaataatgacaagttagcattagaggaatgtcgtgcgtttgagaaggtgtttgggaggaagccggacattcctgagtttagggacctaacacatgcccatggt

SEQ ID NO: 108855 - DNA, 533 bp, Oryza sativa
agcccaatggttcaactaagttgaagttgtctccatgagttaatcgaagcaatccactgaacatcaacatgatgaaagcacaaagataacacaattttcatgtgagttctagaaagatagctaacaagcataataagcatttagtagttctttaaggacgccatatgcactagtatggcatgggaacccatattttgcggaggaaaaaagtgaatcttttggccgaaagacattggttttacaacttttaacaattagtagcaaacttgaacgtacataggcagcacaaccgagagaaccaacatagataaatcaatagactaaagccacacaggataaattgaaataaaaacgatatgacaagaacaccaccaaacacttcatccaagcatccaaggtacagaacttaaaatccaaaagaactaacaaagaaaaatttacctacatagctacacctgaaaaattgcaacatgaacccacgcgagcaaaagaaaaaaacttcttttcataatttcgctgcgcatgattattac

SEQ ID NO: 108856 - DNA, 517 bp, Oryza sativa
tgactatacaagtatgcttttgtgcattctctgttagtattatctgatagctgcataagtcatcctttggatcttttcagataatgtctgaggaaaaaactatttacaagaacactcttggcgaatttttaaggtttggcacataaatcaccaaatggaacagcaaaactctacagatatattcctacatgcacctgggtcttggatagcaaacatatcatattgagaatatccttgtggaggggtttcaggtcatttaagaccgtgaaggtaaattgtcatgttactctccaatctcaattggtgttatgtagttcttggcctgcttgtcctcttcttgcttctaaaatttaaaattgaacagaccttggattattaggttgtaggatcagtggtactaaagaacaagtgaataataaaaaataattacatggtgataaaatatctaatatatgatatatctgctatagaccataaaaggaaaaggaacacaaatggtacgaatttacagatatac

SEQ ID NO: 108857 - DNA, 824 bp, Oryza sativa
ccccatgtaatcaaactaacacacgttcaatacaatctcggcgcatcgccacccttttacttttgttttgtttcgacgagttcttgctttcgggttgagttgcatcggtttcgatcttcaacaagaggtaaaacttgttatggcggcttgcgttcttgggattagtgcttccatctttatgatactctaatcttgtttatgtaattcgtcgagttatcatatgtcttatataatctctggcaatatcgcaatcggctaacatctgttactagaaggcaaccgactaggttaaatatcgatgttgacttagattatataagatatctaccactctatgacacatccaacggcttgattgtctagatattgtccttcttttcacacttatagctgcatcggttgagtttgatcttatgagtcatgattagaatctcaatctctagcctgcctttggttcccgattagggtaacatcggggtttcagccgatcttacctgatttaactacatttatcttatatacttgattgacatgttaaatctgtcatttatattaagatcttgttacatttaagtatattaggcttttgtttggtatattttacttgttttgatatcttaatatagagtggtatcggagtattagccgatacacgctagatctatctgatcggctatgctatgaacatatatagtcttgctgttaatatatatttcgatctaagtgatttatactgtctcggcatggcgaccgatctatcccaatcacttgatttaagaaacttgtattggcatccataccctgagtggtttgagagggttcca

SEQ ID NO: 108858 - DNA, 750 bp, Oryza sativa
ttgccatacttcctctgatacttgttaataatcttagccgaattcacttgaaaaccccgagcttttcctccatcggctgttcggccagctgtatgtaccatattgacaggaaaaggatttccatcgaccctcatcggcttcttggagtagtcaaactttattttaccgtcttcaatagccgcctggatctgttgtctgaagactttacaatcattaattagtagaatgagacccagagttatgccacttgcaataccttctcttgcccaactactcagccgatgggattgtatgaccaacaggaagttgaatatgtttttcccgaagtaacaaatcaaaaatcttatcagccttggtgatgtcaaagtcatacctctcttcttttccagaactctttacccattggcatggtataaccttcttgctcctaacccactcggctgctgctaccgtggaatcatcatcatcatcatcatcagatccatatatgtagggacagatatgactgacctttttaaagttcttccttgcttctgcaaacctctgttcatgcaaggttaccttctgtgcaagatgtgataaactatcaaagtcctgggacgagaatttctccttgatcagagctatcataccctgaaaaaccaaatcggctaactgggcatcagtcaagctcaaactgtagcacttattcctcatctccctgaatctctgaatataatcttgcacaggctcatcatgcctttgcctaat

SEQ ID NO: 108859 - DNA, 578 bp, Oryza sativa
  unsure (1)..(578): unsure at all n locations
aataagtttttcaataggatcaatttgtcaaattttcagataactttcaacactgtttggcagtttggaaaccatgcgcgcgaaggaatgtgagttgccgattttttttatatataataattaataaccccgtaattaaacatctggtaattgcgtgcaagtaattagcaaagtaggatggacgttgtttttgttagcgtccagatgtggacgctattctctagagcgtgcaggtctgaacgttattgtgaacagcgtccaccatacgggtgcagtcgaaccgtgccaaaccggcccgaacgtatccacctaaaaccaatcagcgccgaaataactgccgttctctagcgaccgcatcctggcctcctcggcaatccctcatcgccaccggcgggcagcaaaggcggcgcagtatgcgtcaccaatcgcacgcggctagctgacgacacgccttnnnnnnnnnnnnnnnnnnnnnnncgcctttgcctgtgcggctgaccggctgtggcgccggcagctagcacacactagagattcatcacgcgagtacgtattcactttcatctccattgatcata

SEQ ID NO: 108860 - DNA, 1067 bp, Oryza sativa
tgaccggtctgtgaccggtcacacactgcgaccggtcacggaccggataagcgagcgcgctgcgctgcattaaatgcggcgtggcgcgctcgtccaacccgcaataaatgcggttaggtgagcgccgctgtgctcacctaacccacacacgtggcgccaacaccacagggggtcggagcgccccagccctcggggccgaaacgggagcggcccgacccctcggggagacagagggaggggtggccacgtcaccctcgggcccgacccccccgagggggtcaggccacgtggatgaccgtggctgcccaaacctctaatcacgatactcccggtcccatgtcaccgacagcttatatgtgccgttgagagtgaaccggcacatataacgacaccccaattagggattctatagtagtgcttgtttggagtcacagttatatttttcttattttcagaaaagtttaaaaaaatcggaaataatcactaccatgtgttcgatcagtgtcagatagatacacggacatatatttgtttgcgaaaatgttcttcaactgtaaattgttttggaagccacacgagcaaaactttcctgaatgttaagttgtaaacaaacatatgcccaatttctaaactgctacgaaggtctagttcttttcttcaattccagcattcaactttctcatttttgttaacatgctttcaaaatgttaaatgatacattattaaaaaaatatttaaaagttgtttaagaaaacaaataaatttgtttttttaactttataatagttaatacttaattaattatgtgataataagtttttttatttcgtgtgtgccgcaatatttgtcatgtaaagaacgcggcctgaaatgttaggcaacggcgcgccacacatctgggccttctccacttctccccacacggatcggggcacttggccaggcaaccacatctgcacgaactcaagcctaccacgcctgtaaaaataccctcgcttcaaaagccgtttcggtttctccgaccgagccacccacccaagccatcccgcctgacgcctgtaacactc

SEQ ID NO: 108861 - DNA, 962 bp, Oryza sativa
tctaatctaatttaactatttaaaagagaagtttctaccgtgtattaaaaaggaaaaaatgcccgagaaaataaaaaaggtttaaaaaacgtgtgaggaaaaaatgtcagaagaaacgctaaagaaaacacgctagaaaaaagtttcgtagttaaaaaaaaacatgcgagaaaaaaatatttccatcgtatgaaaaaaaagcatacgaggaaaaaactgttagaaaaaacactagattgatggacacttggtcggataggatcatcgatttttttccatctcctacacgacttttgtttcgtcatctattctcctgtattgaagatcctgcatatctttgtaggtaattatcagactatttttgtgaagtatagctattattcttgataacatattatatggaaataatattagaaaataaacatattttaattgttatttagagaagagtgcacagtgactctattttgtgtagacttgaccatacgaggtagtgtaggatttgattggttgcaagaatgagattaaaagaatattttagattatatgtatgttgtcatatgaataatccaattattttaggtaaagcaaacatcgtaagtttgccatcatcgaggttgggctattacatttaagatgttccaattttctaattttctgattgtcatcgatatggttatgcatgaaaaacgtatattatcattatgttttttcacccgtcgcaatacacggggcttgtttgctagtctatatagaagttcaaataaagagattcgaaaaaattggccacgttccaaatgaggccctacaatgaagctgtacacattgtatcatgtagtagattgagtgtccattagcgcacaccagtggattttcaaatactagtataatactaccttcttgtcattttgattgtagcctttaagttccgggatagatataaaagactcaattattgtggt

SEQ ID NO: 108862 - DNA, 980 bp, Oryza sativa
attttttcaaaatataatatgaaaacactttattgaacttaaccaattatatcgaggtaataaaatcataataagaacaaccattactggtttctattggtacaagaacctttaaatggatctttccactagcaatattaacactggtacttcctccgttccaaaatgtaactatttttgaggtagccacgtgtattaagaacataggtacaaatgattggaagagggttgtgattggtggagaagaaattaaagtaggtgaagagaatggttgtgattggttgagatgagatggtaggtggagaaataacttcattttgggataaactactgtgctaaatagatacattttgagacggaggaagcagtagaaatattggttttttttttttgcgaacgcgcaaatattggtacgtagtagagaccaccctgtataggaatagctatagtactggttgaaccaagaaattgttttcttacaattagaccttgcttgttgcaactatcttatttgaaattagtcataccaaaatggactgctcatttcagagatcgaccggtcccagtcatctcaatcagacaatcacattaattttaaaaaatcagcacactacctactaacaatatatactaacagatacgttgattgatatatataaatggggacacagggacttgttgcattgtataaatgtcaacttgtctacctagttaattagcaacaacacgagaagactcaagtctccaacgtatatagtatcacgtagttaagatcgatgtcgatcgattcatcatttgtgctcttgtgcacatcgatatcctagctaactttaaattcgcgaacatgaacacgttgcaatatagttagttaagtatgatggaactgagggagctagtattttaaatttatgattctaaactaaatattttaaatttgtttagagcgaaagttttaaaaatttgatctcggttttatctaa

SEQ ID NO: 108863 - DNA, 4026 bp, Oryza sativa
tacggattatctacttgattgtagaaataaattaaatattttaataaatagacctaacaaataactttcccaagtgatatagtaaaatggatttttttttaaaaaaagtgtcgttttcaatgatcgagcaaataatccattttaacgatctgataaataatctgaaaataactaaagccagcttgcatgaattgaatacaaggttatgtatctaatatcagcaattaagaaatcaaggcttgctataatatacagatgcaacgagagagttcacaagtagcaaattaacaaacacccaaacagtgagcacgttgtagtagtcttgtagatcgaatggaattatgcaggtatgcataatccttttttattaatttgttcatgctagctaggtacatgtgtattaattagccaagcccagtacatcgatgtgggaagagaagacaaacagatggatgtgtctgaatgtgcatgaaaacaaattggactgtcagcagccgttatcatgcacgtatatatgggaccatttggctggtagctgtttccgaaaccatttgagtagtaacaattccgtctcatcgatctttggtaggcacacacatctctttctctcaccaggagatccatgatgcatgagtgcatccattggaccaatggactatatgtactttataacatcctacctacaatattattgcacattgacatatttttttttaagcttctttcctgaaataatccagagagcatgaaacataggcccatgaatcactaacaaactactttaattattgctagatagtcatcagtaattcctgatatatataaggtgcactgatctattgagagtcctaacatatatagtgtattaatttggaggcagatatagagggtagcattttccaggctgaaataaaaccagctggtgggtagggcggagccctgctcctttgtgaaggcaagggcgagttcatgttttcacccacgggtccccatgtggtcctaaaagtgtagaatcacacatgcacacatcataaagacaatttttttttttgaaaaaaatatcccttttcactgattttatataaatatactccctccttccctaaatgtttgacaccattgactttttaaaacatgtttgaccgttcgttttattcaaaaacttttgtgatatgtgtaaaactatatgtatacataaaagtatatttaacaataaatcaaatgatagaaaaagaattaacaattacttaaattttttaaataagacgaacggtcaaacatttttaaaaaagtcaacggcgtcaaacattttaggatggaggtagtacatgtttagaagggatttgcagaagtaaacaatttgcataaacatactctcagcgacggtggtatatttgtaaaaaaaaaaattgcatcccggtcatttctttgggcgagtcacatgtgtcgctcatgcccattgatcgagttgtagccgcaccatgccatcccatcctgaatctcgctccactagcatgagtcattggtgcacctcttcctccatgctggcacatccatgatcatccattctagctacatcaccatgtataccaaactaataacagtcctctcaacagctttcgtcagccattatcatgaaggattgtgtcttcaaatggaggtccaaattaaagccactcacagggtcctgacggaggcttagtgtaggatcgtaaatgaccttttacactctaaaactagccaatgagatgggggctacttcacttatataatagatcccttgccattactccctccttttctaaatgttttacgccgttaacttttttaaacatgtttggccgttcgccttattcaaaaacttaggacctgcagggctaggcaaggaagtcagggtcaagggagaggcattctcatccaacccagccataacctgtgccactttgccaaccctaggcatatagaaggagatagagaagtatggtagccagccagagatagaagtatgtgtacatgtaattaatataattaacttattaacagatcgatgtaagcgtgcaggcaactagctagttgtgaactgtgacgtgaccaaggcaaacaagtcaacctctaggatgcaggacatgacccaacaagaatccattcttaggctcaactgctgaaaggccctgcaaggttgggtcgatcaaatttctagccatagctagagtaattaatatacaccatgcatggcacacatgtatataatcaaagagcctacatcatctctttctttgctacaactaatcatgctggattagacaacaaaagaaattcaatcaaatagatccctctttaacctctctctctttctctctcccttactttttctcgtacacacaaattaaagggacacagtcctatcaaaatcgacaagtatatatacacttcctgtcaaaatgccggaaatgccgttgagatatcttgtcaggtaaaaaaaagtgtgaaaatcaggaaggtaaaacattaattttctatcgcgatcttctggaggtagtaaaaagcatgtgttgtcactgtacatgttctctcgatatctcacctaactttcacactccattgtttttcattattttccttattgcaatttatatcactgatgctaattgaacaccatatggacgtgcaagtacttaataatgaacacaatgtatgtactgttatgcactagcttaattcagagtcaaataagaggacagtggcagagttgctagaattgcttgattgtcaccatcttctctagattagattgtaggatagaacatgttaattacttctagctagctgtacaaaacattagcctgtgagttctaatctcacattaagagtacttagctcaacgtgaccaagtaaatctaaataaggaaattttggtgattaggactgaccagtgtcgattgaagccataactgccgtcttgctctcttcttcttctttttcttcttcttcctctagttgatctagttgagggatctcagctccttcgatatcgatcggtgtatagtacgtactccgtcaaatttttctatgaacttagttaattttagagtagtttaactttaatcaaagtcaaaacaacttataatttgaaacggagtgagtagatgagagtgagagatccttgcttgaaaggtgattgtcctcctccttatagcgctagtgtcactgcagggcaaaagtacaaaatccctccagcaaggatcggctgttttagtgttcatgtgaaagtgcgagaggtggttagatcgatgtttcgcttgggagatctcccttttataatcactgtgagaaattaggcctgttaccacgccttccttacatgtttacttatcggatggactaggcccaatgtaatggtgtttcaagattgttagctgagagatcaacaaacatagctggcaggggcggatttaacgtgggttcaagtcccccctacacccactggacctatggataccccctgagtccacccttcaattttttcgccatggttgataacataggaggtgctaaaggtctctgaatagctggaggttaaagaaaccacgtattggtatgttgagatgatgtgtttaatactaaaatgatgtgtatacgccggcgtactcggtatgttgagtcccccaacattttgttcctaaatccgcccttgatatatagccgggtaagtaattattacatgactatgtaactattattggcttaacaattgttcatttggaaaaggtcatccttcagaatggatggatgggtgtcaattcggaagggggccgaacggagacatccattcatatatacagtgtacttcaattttaacattacaataaagtactccattcacccgttctttcattgtgtgtctcaaatagcctgattacctgagagtgaaatctagctagggatagtttgagattgtgagttgctatgacgagttggatctgattgattttagtttcagccaacacacctttaatttgatcttag

SEQ ID NO: 108864 - DNA, 706 bp, Oryza sativa
ccaagctggatcgcgcacgctgccacaactcggagctggaggagaagctccgccagattagtgcggaggggcaggcgtggatgggcgtcgccaagagccatgaggccgtcgccgctggcctccgcgccacgctcgactagctcctccagtccccctgtgccgtgactgccgtcgccgccgccacgaggaagggcgacgccaaggacgcgcagtcgtgctgcttcaagaccccaggcggcgccgccgccgccactgccgccgacgcggtgtccggggcgacgtcgtgcaaggcctgccatgtcacggaggcatccgtgccgctgctcccatgcctatgcgacgcctgcgaggccgccgccgccgcttgccccgtctgcaccgccaccaagaacgcctctgtccatgtcctcctctcctgaagtcactcacacgtgctacaccagccagccactgcatggagtaggagattttgatagcgcaacagctatggccagaccgaaaccgggcatccgtcagccaactccggtgtcaagcaaaaagctaacaacaatcatcctgtcccaagttacatggaaattcatgctagggaagccacggttctgtgcatctgtgcatcagtgatctccgggccatgcgagttttgtcagtggaaacaacagttttcggtgcggtggattgaatggttgattgccaatctcatctgccg

SEQ ID NO: 108865 - DNA, 2888 bp, Oryza sativa
tgggactgggccctttctggaaatatggcccaacacgcagttaacactccctgtttttgtccaacaaggcaatcatgtaaacagagttacagagcctatctgtataaattactctagtcaacagggaagtactcctaaattggtcaacaccttttccttttcctttagtagaaaaactagtctgaactctgaccattccaatattccatggtggctaattaaaaaaattaagttagccggctcggttttgtaaaattattaatgtaccagcaacaactgctacaacttgatatataatgtgcaaactttcaatggggacatgcacaacatatgctattacaagttctatgtttgtttttgactggcgaatatatatatactgcactacatttgactacgctaaagcctacagctagtttttcttaagtagttaacacagacgtgttggtttcattttgtttccagtatcatctgctcccaatttgtgtgcattctcatggttgcttcgatctccaactagtaggagtataattcccttgttagattgataaataaataatacaacatgcagaaatatcgaacgatcgatattattcacacacggacgaaaaaaaattgaattcgattttgttttaatcaacttgcctagtttgattcgttgaggccggagaagtatatactgtggcatacatatgcaattcattaatccctttgcacatgtatgtatatagtttcaatagaaaaagctaggcagcattataattaggttcgcgcgactaatcggcgaagaggttgctccgtgtgaattaattggccaaatccatccaaaacaatttcataaaagaaatatttagaaattaataataagcgatcgactcaccaacccaccatctgaattggagtagaaacctatgtggacagcctttgacaaaagttttacttttaaggagttaacacatgaatatttattaccaagttaagacttagacatttagctacacgctttcttagataccatcttttacgttttaccgaaaaaataagcatagtctatctggttagattcgtgtgttggatatactcagacttggcacggatatgcttatatctatgactaattattttttatggtaggtgatatatatcaaaacaattgagcatctcttcattacttgcccttttgcaagatttgtgtggaatgttttctttagcacctgggtaagtttgaggagaaggagattgggaagatacggaaaacaaggtgagctattagcgcatgatttattgagtattaactattttaaattttaaaaatggattaatatgatttttttaaaccaactttcctatagaaaatttttgcaaaaaacacactgtttagtagtttggaaagcgtgcgcacgaaaaacgaggtgttttctcatcctatctcacacaaacgaacgcagcctaaggcagtgtgccgtgtgaatggattggggggaatgaacaggaaatggtgtttgtgtgtgttgtggacttgtggatgggtttggaaaaccaggaataaagtgtgttttcaaaatgaaagtttctctacccagttgagctgatatattatatttttctctgaatctcttcatggtccatcttgcagaactcgggaaatgaaggaaggctgcaatggggccatacggggtgtgcacctgctaaggaaggaaggtggcaagtgaaatctacacttcaagacatgcatggaggattggaggtcgggggccagtagaccggaacatgttttgggctggcttcaaactaatggggatggcattgttccagttgtgaagtgctgctagtgttttttttctttttctttgcttagcagtaggtttactttctgaactgtgtaaacctttcttttccatcaaagaaattaagagggagaagcctggcatctctgttgtaaaaaaaatgtggcgtatatatcgatggtgagatggttgttctggttttgtcaatatcaagatatgctagcacattcttttttagtgtttatagaggtaaatgtatatgtttgcatttataggggaaagtgatttcatccctggaggggatatccccttatttcgtgcatgacacctaaatagtcataaaaaatatgaaaaaaaaataggcatcatagattaatatgaaatatatcactccacaaacatgcaagtttaaattcaatttctacaagttgtaaaaaaaataacaaatatagttgtgaacgtgcgataactattttcagtttaatttgttatttttattgcaacttgtagaagttgaatttggtcttgtatgtttgtggagtgatatattttgtattaatatatcttgtcaatttttttaaaattttttgataacatgtaaacagcgagtggatatcccctcgagggataaaaatccacatctaatttataagagtgaatgtgttggcgtgtatacgagcttctgtgtttgcgtgtctatagtgttttaaagaaaaagatatattttttgaacgagaaaaataaagagaaagtactagcttgctgtctgtgcagggctatatggttatatataacttcatacatgtgaaatgagttctaaaagaaagcgaataagttcatttgactcttgattccttaacttttaaaaccagtgcaatttaactccctcaaaggttttggaggccggtttcacaaacgtggcgggcggtagatcttcgttccacgtgatgttgatgtggcgtctatgtgacattagaattaaaaaaaatatgtgtgagatcctctagtaattcaaaaataaattgtgggacctgctaacatatggagcccacatgctatccattctccttcccttcttcatccagaaatgctaatgggcgg

SEQ ID NO: 108866 - DNA, 1047 bp, Oryza sativa
taaatatggcacgcatgtattttaagatttatctttgaccaagaattagttttaatttacaaagatatttgatagaaaattagcatcatttcaacgtgtttttcaatatgaatacaataattctatgtatatattattagtcatcaacctgtgcacttgcatgggctagaaaaattacgtgacatcaattaactagcgtggaagctttattggtgcctccaattactaaatataagattttttctttgtttctcaattctttcggtcaaaaacgagcatgtgtgttattcatagaaacggaggtagtatttgtaagaagtacagtatcgaatttcaaaaaagttccgaccttgtgcgataatatacacacatattaacctacataggcaagctagctagacctagaaatataccatttctaaacctattcggtcacttactcacgttggggagcctaactaaactaacatggactcacatggaatgcaagccagccatggtactaactcgtctactacgccatagtacgctacaaacacaactaagttatcttatgaaggactactcaatagtacacttaaaacaatgttactcgttgccttttaccttcatttgacgggtacgacctaagtgtatctgaaaatcttctattctgtccatcggcgaaagcgtgcaaatgtaaaattgcctggtacgcaggactagatatgaagagtttgttcagagattgtgcaacaaacatgtacatccatcaactgtattgtcacgccctgaagtttccccctttttccttgctttaaaaaaatggttaaatgaattgcgcgaagaaattgtttgattaacttagagctaattccttaattaataaatgcaaataataatcggaattggcatgtggaatttttcttgagttctacatgtcgaaattcgctaacaaaatttttagtggaattttcagagctctcgaaataattttaccaattaaaaacattaaaccgcaataaataatcccaggaaaatctttttcttttcctcttttcttttcct

SEQ ID NO: 108867 - DNA, 4443 bp, Oryza sativa
cattaggtgctaaggactttaattagtagaaattgaaatgttgtaaggtttttttgtaaaattgctttgtttgccatgtgggcttatggacctaaatgcaattcacctaatgcccagggaccttgttgtatagggtttagggcttaccctaaaacatgaaattactatttcatgcattcactacttgatataatagcttgatgagtatattgttatcacccttgctttaaccccctcttttagaatcaatttggagtttttgccgaagccaggagtttaatcatataaattagtgtcattctaacttagttcccaagtatagattagatagatggtttaattctatagcaaaacattagagttggctcatcctgtagcttctacagtaatagttagccacaatcttgtaaataccctattattttatgtaaagaaatctccattggagccttaatcaaatgtatgcgatgaagattcagattgttgaacatgtattaatctactgatccagggttaatacagtttaaatatgtcggttaccgaatctttaattttgggacccgacaaggtgtgtgggtgggggcccctacgatttgggagcctagagcggccgtaccgctcgcaccccctcccccctgagccggccctgactacatgggcgttaaaaggccaaatggcatcttatgacgttttctgggcttgatggcgacgaaaatggacgccatagactctatgacgacagaaagattatcactagattaatgataaaaagataagctttctttatagaacgccattagagacgcatgataggtgacgaatcatatttgtcacacgaatgtcacagatttcatagcatgacttaaaattcaatttttatgacgtaaatgagcatcacatataattagattcttgtagtgatggcttgtttggctattagagaggcagtttgagacatacagcacacagtttcatagcgtgtgcgtgcctagttggcaactggatcctagtagatgcaaattttgaaacattcaacccaacccaatccttcttctcttaatcttctcttcctacacttgtgtttgtgtgtgtgtgtctaagaggctagtagagttagctagcctaaaattttttgcacgttgcagctactaactgtgctgctggcttgtcgtcctctgcttcaacattaaagagggagctaatagatcggtgattcactttggtttcttggatgctatccagccacgtcaccatgcatgcgaattttgtggatggagtcagaggctctgcatgcacggagctgatttaattaattaacttgttgccagctagtacctaattaagcatgtgtgttaatttattattaattactttgctagtgttaatttatccttagtttttttattccaaactactagcatgcatgcctttgtcagagaaaccgatggaatatcctcgtttcaaaagtccatgcataatgtgcatgctgtgtggattcgtgctgtattttcctgggtagataagaccaaaaaatcccacttaccaactaggttttttaaaagtctggtacatcgtgaaccatgctgcttcacgtggtcggaactatatacgttaagatcaaatgtgctcaacgtggtctggcacatcatggatcatgctgcttcatgtggtcggatctagatgcattaggaataatccttttcgtagtagtgaaactaaagaacttcacttgccaactacttcctccgtttcacaatgtaagtcattctagcatttctcacatttataatgttcctaatgaatctagatagatatatatgtttaaattcattagcattaatatgaatatgggaaatgctagaatgacttacattgtgaaacggagggagtagtttttttagagtctgaacaaagatgaaactttttggaaaggtgctcctgatgaccaagttcaattcaccaactgaaatcgcacactggatttacatgaaaaatgcgagatagacaaaaatgatttctttcggttctaaattaatactcccggccatttgggaggagcaatatgtacatatgcattcatcacacttcagcttttttgtcttttttttccttggagttttaagaatgctcataattagggcatgcaagttgatccattgatatattcgcaatatttgacgatttttttttcattttaaaaattgttgacgatattagcttaattttggtatggaaaatatcggttaatttatccccaatttttatcaagagagaaaatgaaccatgagagttgaggtgctaattaaccacaagcaaatattcattttaatttgtggtatatatatatacacgagcatgcatgtaaagatggaaatatgtgaaaaatataatggtgctagtagatttgtctaaaacacttccataatactatgatcaggacactcgataaggacaaagttaaattttagcgattgtgtcattatcaaaattatcaatgaataattggccagagggccgggattaagggtctactactgtcctgccatttcattaattaattagattaagtccccgattccttgcatctctaattggcctacgagaaccgacaaaaatcgcaagatgggaggattgtggtaggttatcttctccaactgtgcctctcaagtggccataacatattagccagaaggataaataatcatcaatctgccttcacagttttgatcatctcatgagacatatatataaaccacccattagcaagagtctcctaggtgaattaattaactatgctgatacacatatacttaattggtataagaaaattagtagtgatagttaattagtataaaagcatcaatcaaatggagactattagctagctaggagaccaggcaagcaaagcaaagtattgatcttgatgaatcctccagagagattaattgcatattgccagttcctcctgacctattatatgcatgcaagtgctctctgtacttgtgcggtgcaacgacgagtaagagtgcgtacgtttatagtagaactgagggggtgtgccttatatacgccggacgagcaaagagtgcgtacgtttgtagtgacgtctccaattttagtttctatggtagtgaaatatgcgacgtttgacacctcaaaccggagaaaaactggagctgtgaaatgttttctttttttatatgcgtggagctctgaaatattgacagttttgtttttttctataaaaaaagccaagatgagttgacgacttatcggtaggcactcctcgatggagggagatgagcttaaaaagtttcagtaaatggacccatgcagtggaaatgccgagtggagtggagcagtaataaaatttaaaatgccacgcgcagggcatctcgaccacgacaggactctccttgagatcttagaacagtgtgtgcttgctagctgaactgcaacagtggaacagtaataaaatttaaaacggagatgtgcagtgttcacagaggacgagtgtgctctgtgttctctgcttgtgaatagatatggcgatatctgcttgtgaatagatatggcgagtactattactgggtatacatgattaggacagatgttagtttgttctgcttgtttggagatggatttgggagcaaatgtacatggttagggcgcaaatgttagtttgttttgctgtggaggggagtgggtttttgtcacccccggaatttctatccaaaattccaaacgcttacatgtgcgttaaaccctcgtccaggaatcagccgaggcacataataacaaattgataatagagtacgaataaacagcgaattaatattcacaaataataaatcattacagaggtagatagtttctctcaaagaataaaattctacgcagcggaaaataaaacaaactaaagaacagctatggtgactccactccacaagcaacttaacccggatcaagcctagtcctccagaacatcaccttcactgaagtactcctcctctgatgaatgaatattgcaagaattagcatatgacatactcaacaagccacacagcaaatatgcaagtgcacaggataacaaaggacggcataataaagttcatttgcataaacaacatttaataaatatttaggagattagtaaaacagttgaataattaatcagtattaaataaacactacacaacacacccgtgttgcataggcccaacctcatctgaacaaccaccccggttgtacaaatcaaacctccataccaggaatatgccattccaaaccaggagtcaaattaattaacacaattaccaataatgagtggtgtgagactatcatgaaaaacattgttcaactcacccgtaaccacgcgcacggctattcgaatagttttactctgatcagaggtgtaccactgtacccacaagacacaatccc

SEQ ID NO: 108868 - DNA, 517 bp, Oryza sativa
gtcaaaatttgataggtaatttgagtgaaagtgtaaaaactggaaaatgaaaaaaaaattacaatgcaggtaaaactgaagaagaaaacgagtcttggagttttactctacttttggttggaatttagaagaagaatcgaagcttaatcttttgttcttctttccggatctgttaaacttagttttttttcccatgtaatggcaaaatcttacgtactcgtgactttgtttggctgtatataccccacaaaggtgcagaggccggatttaatctaatctattttttttaaaaaaaaggaaaaacttaaattaggagtagtcttagtataattttatcaccgggatgaaattgtctgagattaagaaagcttcatttatcaaaaagaaatgaaaaaaaatgttctgctactctcaggcctccttgacaagttgctagccacttgatgaacagtttaggttgattgtgcttattctttgtttattgaaatctaaaatgaatttgaaactgaacatttag

SEQ ID NO: 108869 - DNA, 725 bp, Oryza sativa
agtaagcaataaaataaccttactatttaggaacaaacattgtgaaagctagcaatagcaattactaggtagtatggctactaccagcaataagaaactaaactatattattagtacagtgaatagtgtaggtgcagggtgtgggaggctagggattggtctttttttctattgcggggcataccttatgttcaccttttgcattcacacattgtggcatatgtattagctactaccactgattcttgggcccaccttattaccaagtttagcaataagcatttctttttgcctctagggaagaatggcaaaggcgcacttatgaaatgtgaggagagttacatgctatgccataggtacagtgataaatattgtttgattaattttttgaggctgttgtaacgattgatctcgtgcatccaaacttgatacaactgctgtaaatagataatgacatggggcactgtagctctccgccattccaactcagggcatctacaatataaggcacgggtagtagtagccttacgtaggctatactgtctaaagccacatataggaaactctacccccaataaaggatactctcaaatggttctacaaaatctgagggtactagtatcccacaatacgtgtctcagcccacaaagccacagagttattttcctcttctatcctttttctatttagccttttcttcttttgttttctccacctccttgcct

SEQ ID NO: 108870 - DNA, 2744 bp, Oryza sativa
gactaaatcataaagaaattgagaaaatctggaaatttcgggctagctaattacttgctggggttgggggggggggtttagaaattagcgaaattgcaatcacttccttaaactgtcctgaattgttgattaagatgtgaataaatacacgtacatataatacatttatacttcctttgtccaaaataagtttatgtttcatccatccacatgtactaatcaatacaaaaccaaaaatattagaatatccttattttatcaaatcctaatgtaattattctccacgtattttctacttaacaaacttgaatacaatgaacataaaaagaaataaacttattctgcgaggaaagtccatgactttgtgaaagatggtatggtcggcatctccattggtggaagaacatacgtacatgtgtgcaggatcggaacacaccattggtgcaaattaagctgcctgcacatggggaatacgtgcatacgtaatcaagttgacggacacatgtacataaaaaaacgatgattaattactttattctcacaacgcccatccgtctgttcgtctccatgctgtgccatcgattcgcaccatcctcatcatcaatttggccgtactagtgatcgaaggagggtcagccgctaagccaaattggcaagcagtgacatagtttccagaagtaaggagctaaagctaggctgctaaaacagagcaacgaatagctgggctatcccatccggccatcaccctgcaatgcactgaacaacaaaaggatgatggatttcctaaagataggaaggaaacgggtagatctagactgtcaaatattctagatacaatgaacaaaaaattcgaatgatttgaacccaaaaacatatgaatgttacacatgcagtctcaaaatttaaataaattatcggctgtaggcggatagggagaggcactcctcggtggcaggcggagaaatgaaccagcaccgacacatatatacccgatcactactgaaacaattttgtgaaatttgcttaaaaatgctactatattttccttagctcaatagtaggattttttttttctgactccactcctgaacagagaggaagtgctctcccattttctatcatcagaaaggtataggctaccagaacagagcaacagaaatgtaaacaaagactaggctgatcgcatacacaatcaggctgccagaacaacaaaaaatacagacaaaagcatccagctccccagctgggacatatccaacatttcctttggtctagaacagcatcagctctgtacaaatgcatgatcacaaataacaaagagtatgggaacagtcacccttgcttcagagatatgatttcttatggaatataatcaagtacgtacttctgtactaatgatcaatggtacacacattacatataggtggttaaactaagctttcgcgaaacctgcatggaggcatggagacatagaacaaaacactgttgttctctagcttatagaacctctcgattgcagatggacactccaaatatgtcgatcgatctagccctatatatatatgcaatgagtgttttcagataagttgtgaatactatgttaatatatgcgcacaaactataaggtagcagcactgaattgctatactgcatgctgaagaacatggcgagcacctgactaaacactgcaagcgagagcagcacagaattaacttagctagctagccaagctcgatcagtcaagctggaggacgaattgtgggtgccatcacccaagtaagtatatatatctatatatatgttcactgcgtcgagcttattcgggttaattgattgggaattgggattgaaacctcaatttttggcctgagcccccaaaaaatcctggaaatggtatagatattaggatttaacggtgtgaaaattcatgtcaggattgtgtttgcactcatttgtttaaccgaaaatgtgaaacttcatgtcaaaacagggacaaaattcatgttaaaaggcttgatatcaaaataagggtaaaaatacaaagtcctcagaaaagtaggggcaaatctataaatataacgactgtatgtctttgacactggaatagggtaaacacaaagctttagttaaaaaaaatgaatacaatcacaaaattgtaaaagtaaatgtaaaatcaccattgaagtttaatttaaaacatggataagaatatgattgtccctataatatcaacaagctttctacataatattatttgaaaatattactagaatggtacgtaggtctggttgaaaatggtaaaatgttagttttttttttctttgggtcggcttggccttgacaatttaaattgagcccgtgcattttcaaactaccgtgcccggggtttaatgaaggttccaaaagcattcagtcaccaaataccgctctcaagcggttttattgataacggtgagtaaagtgctactgtatacaaccaaaaaccggtagaaagcttagataaattttgctagaattttaaatttgaatttgaattttgaaattggcaggttcaccaagcagtttatcaattcttccagatactaaaggcggtcagcaacagcgataatcgagtggttaccattgtattttcaaacccctgcagtgcattgaacaagtttgcacccccaagtgctttttcctcgacttaaatttgagtatatatatatatcgcagtggatcatggaaatcatgttttgcttgat

SEQ ID NO: 108871 - DNA, 2010 bp, Oryza sativa
tgaacaaatcagttatatacctgtaacaatcatactttgttactatgattcggcagtaacattatcttagaagggtagtaacatcatatgttactgcaaaaatgtataggttgttactgtaaactttataggttgttattgcacttttggcagtaacaatataacgaaatttgcagtaacagagaacatgcatagtaacagtgactctatagtagtaatgtttttaaaatctcaatctttagagagtactaacgtacacgtcatgtcttatttttctaacccatttgtattgtggcgttcgtaaaaaaagtgcttaacgaaactagaaccatcgtaactattttttaacgttgttactgcatattggccatcgtgttactacgctgttccagtgagacgagaactaaaaaagaggtaaatcacaatctttagagagcaatatctctcacatcatatcttgtatttccaatccgtttgcaccatgaagttcataaaaaaacgcttaatgaaactagatccatcatggctacttttttacgttgttactgcgataatgctgtcttgttcctgcaggatgaccgtcctgttactgcacgattcctgcaagacgagagcagcaaagtggtgggcgggtttgaccgacgggaggacgctttgaccgaggtgggaggggggttttgggccctagggagggtgggggaggtgggtttgacccatgggagagggggtgtagaatagtttttctaggggaggggtgtagaatagattcactatatatatgtgtgtagattaattaatatttatatgaatatgaataatactagaaagccttatattatgaaatggaggaagtaccaccgaaaatagtgtgcctgaagaccatagcaaaacagtgcttctttgtactgtgtccatgaggatttttactgtgggcggcgaagtactgattgaagtaaatggatttaatttgttcggggatctatgaacgagtagtggaaggctggaagctatgggctaatgcccattactgttgccatccgtttagttggagacagccctaacggttgtggtcaaccatatatccacaccacatcaaaggtatccacacaacttcacgggagaggtgtctcaaactccaccagttattgaggatcaggattctctgcagtcactgcaccgtacctttatcattgatatgtaggtccgatgtggcgtcgggtccatatgtcagtgataaaggtatgctgaagtcgactgcataggatctcaatccatcattgggaggtatgctttcatatatattttttttatcacatgacagacagacatatattgtcacaccctgaagttctcctcccaagcctaaaatttaatttataaatgactctaagaaaatgccggtgcaaatcaagagaaaaccctaagaaagtaatacaaataataatcgaatctgacatgtggaatttttcttgagttctacatgtcgaaattcactaacaggatttttagtggaattttcagatccctagaaataattttaaccaattaaaattgagcaagcaatattctaattccagggaaaatccctttctcctttttctttttctttttcccttccctttccgaatgggccgccggcccattctctcctttttctccccctcctccctgagccaggccgccccgcctccctcctctcccggggtcgccgacaggtggggcccacctgtcgggtcctcccccaacctcccgccgcccgcgccggtcaccaccccccccaaaaccgctgccgccgcgccccacctttcccgctttccccgcgctcacgccgcgtcgcccgcgcccacgccacgtcgccgccccctctccccgcgtctcccagccgcgcccgcgcacgagaggggcgggattcgattctgaatcctcccccaccttccctctctccttcctcacgtcgccggcgaaatcggacgcgctcgggtcgttcccgacctccccgcccctataaaa

SEQ ID NO: 108872 - DNA, 817 bp, Oryza sativa
ctcaaagataaatgatatgtcatcggcatttagccaatcggctatcatttatggatttaatcacgatttctttgtctttgtttcttgttgattgcaggatcaaatcaactggcacgctcatacatccgaaggcgagttttggacctgcactggagttaagcagatttcccaggcctcgtgttttccatcaacactatccactgtaaactatgaatttataagaattctgtcgggtgtcccatttcttttcatttaaaaaaacttgggaattcatccatgtgcgcaaatatcaatgtacaccaataaattatcaagggagggagaccatcttttgtcccgaaattcctaatgcgcgatcgctcgcgaggcgcgatcaccctctcttccacgtgtttcttttttttttgcaccacattactttcctattttattaaatttatacacctaaagtttgtacacctcaattttacacatctaaagtttatacacctaaagtttatagacccaatgtttataagccaaaagtttatatacccgattcaaatttaaatttgaattcaaatattttttatatatagtatttctatacatctaaagtttatacacctaaagtttatagacccaaagtttataaatcaaaagtttatatacccgatttaaatttgaatttgaattcaaatattttttatatatagtatttctatacataaattttctttgttttttattttttaaaaatttatggtgtagtaggaagagaagaaagggaggaggaagggggagattagtgtgttaggggggggcgatgggggggggg

SEQ ID NO: 108873 - DNA, 837 bp, Oryza sativa
aatactctaaattagcgtccaaacatccgatgtgacatgggctaaaaagttttagtcccatctaaacacccccttaatctgaccatatataggggatatcttcatctgaccaatcagcatggagtcatggacaatgacatgtttgtcatgcaatccaattaggttgtgtttagttcagcgcaaagtttaaattttggttgaaattagagatgatatgactgaaaagttgtgtgtgtataacaggttaatatgatggaaaaagactgaagtttggatccaaactttgaatctaaacacagccttagaaaaggataaagtaaagcatctccgagaagtactatgagcgctgtctcttctccagatttcaatcctagaactgactgtttgagcttaatacgccacccgccgttcggaagtgatttttggctgtgataactttctcatttttcattagcatgttttttacactgctaaattaatgttatgttttttgtaaaaatttctgtacataatgtttctttaaaaatcaaataaatccattttaagtttatttactaattatacacagataatttatctcgtttttacgtgctgctaatacgttaagcctagcagccaagtcaaactcaatggaacaaacaattgaagccttgtttttttgccacaatgtagctttcattagccacaacttatatctaatatgctaatactccatatgcattcaaatactgtcactggatatataccaattaagagtatttatcgatcttggccgctcgtttttgaaatgtatgtataaatacttccaggaaaatgatcgatgagtaatcgatctct

SEQ ID NO: 108874 - DNA, 731 bp, Oryza sativa
atatattggagtgtattgggtgcgttcgtggtaaaatctcacttcgtgattcgcgcgggtacttttgtcatttaatgccaatattggcatatgttgagaccccacgggtgcgatgtttttgaccggattgaataagatcaaaaagcatccaaacatgaattttggacatattggagtgtattgggtgcgttcgtggaaaaaactcactttgtgattcacgcggcgaacttttgtcaattaatgccaatattggcatatattgagcccccacgggtgcgatgtttttgactgtattcaaaaagttcaaaaagcatccaaacatgatttttgaacatattggagtgtattgggtgcgttcgtggtaaaaactccattcgtgattcgcgcggcgagcttttgtcaattagtgccaatattagcatatattgacccacacgggtacgatccttttcaccggaatgaaaaagttcaaaaagcaccaaaacacgatttctagacatattggagtgtattgggtgcgttcgtggaaaaaactcacttcgtgattcgcgcgacgatcttttgtcaattaatgccaatattggcatacgatgagaccccacgggtgttatgtttttgaccggaatgaaaaagttccaaaagcaccaaaacacgatttctggacatattggagtgtattgggtgcgttcgtgtcaaaaactcacttcgtgattcgccgcgggaaacttttg

SEQ ID NO: 108875 - DNA, 723 bp, Oryza sativa
attgggtgcgttcgtggaaaaaactcacttcgtgattcgcgcggcgaacttttgtcaattagtgccaatattagcatatattggcacacacgggtgtgatgtttttgaccggaatgaataagttcgaaaagcctccaaacatgagtttttgcacatattctagtgtattgggttctttcgtggcaaaaactcacttcgtgattcgggtgacgaacttttgtcaattagtgccaatattagcatatataggcccacacgggtacgatgtttttgaccggattgaaaaagttcaaaaagcaccaaaacatgatttttggacatattggagtgtactgggttcgttcgtggcaaaaacacacttcgtgattcgtgcggcgaacttttgtcaattagtgccaatattggcgtatattgagccccccacgggtgcgatgttttttgaccggaataaaaaatttcaaaaagcaccaaaacatgatttttggacttattggagtgtattgggtgcgttcgtggcaaaaactcacttcgtgattcgcgcgacgaacttttgtcaataagtgccaatatttagcatatataggcccccacgggtgcgatgtttttgaccggattgaaaaagttcaaaaataaccaaaacatgatttttggacatattgcagtgtattttgtgtgttcgcggtaaaaacttacttcgtgattcgcacgaagaacttttgtcaa

SEQ ID NO: 108876 - DNA, 1982 bp, Oryza sativa
atcttgagccccccgggtgcgatgtattttcaccggaataaaaaagttcaaaaagcaccaaaacatgatttttggacatattggagtgtattgggtgcgttcgttgctaaaactcccttcgtgattcgcgcgacgaacttttgtcaattaatgccaatattggcatatgttgagcccccacgggtacgatgtttttgatcggattaaataagtttaaaaagcaccaaaacatgatttttgtacttattggagtgtattgggtgcgttcgtggcaaaaactcactccgtgattcgcacgacgaacttttgtcaattaatgccaaaattggcaaatgttgagcccccacgactgcgatgtttttgactggattcaaaaagttcaaaaagcatccatacatgatttttggacatattggagtgtattgggtgcgttcgtggcaaaaactcacttcgtgattcgcgcggcgaacttttgtcaattaataccaatattggcatatattgagcccccacgggtgcgatgtttttgactcgattcaaaaagttcaaaaagcatccaaacttaatttttggacatattggagtgtattgggtgcgttcgtggcaaaaactcacttcgtgattcgcgcggcgaacttttgtcaattaatgccaatattggcatatattgagccccacgggtgcgatgtttttgactggattcaaaaagttcaaaaagcatccaaacatgatttttgtacttattggagtgtattgggtgcgttcgtggcaaaaactcactccgtgattcgcacgacgaacttttgttaattaatgccaatattggcatatcttgagctcccacgggtgcgatgttttttgaccggaataaaaaagttcaaaaagcaccaaaacatgattttggacatattggagtgtattgggtgcgttcgttgctaaaactcccttcgtgattcgcgcgacgaacttttgtcaattaatgccaatattggcatatgttgagcccccacgggtacgatgtttttgatcggattaaataagtttaaaaagcaccaaaacatgatttttgtacttattggagtgtattgggtgcgttcgtggcaaaaactcactccgtgattcgcacgacgaaattttgtcaattaatgccaaaattggcaaatgttgagcccccacggctgcgatgtttttgactggattcaaaaagttagagaagcatccatacatgatttttggacatattggagtgtattgggtgcgttcgtggcaaaaactcacttcgtgattcgcgcggggaacttttgtcaattaatgccaatcttggcatatgatgagaccccacgggtgcgatgtttttgaccggaatgaaaaagttcaaaaagcaccaaaacatgatttcaggacatattggggtgtattgggtgcgttcgtggcaaaaactcacttcgtgattcgcgcggcgaacttttgtcaattaatgccaatattagcataaattggcccacacgggtgcgatgtttttgaccggattgaaaaagttcaaaaagcatccaaacatgatttttgtacttattggagtgtattgggtgcgttcatggcaaaaactcactccgtgattcgcacgacgaacttttgttaattaatgccaatattggcatatcttgagcccccacgggtgcgatgtattttgaccggaataaaaaagttcaaaaagcaccaaaacatgatttttggacatattggagtgtattgggtgcgttcgttgctaaaactcccttcgtgattcgcgcgacgaacttttgtcaattaatgccaatattggcatatgttgagcccccacgggtacgatgtttttgatcggattaaataagtttaaaaagcaccaaaacatgatttttgtacttattggagtgtattgggtgcgttcgtggcaaaaactcactccgtgattcgcacgacgaacttttgtcaattaatgccaa

SEQ ID NO: 108877 - DNA, 1022 bp, Oryza sativa
aaaaagttcaaaaagcatccaaacataatttttggacatattgtagtgtattgggtgtgttcgtggcaataactcatttcgtgatttgcgcgccgaactattgtcaattaatgccaatattggcatatgttgagaccccacgggtgcgatgtttttgaccggattgaataagttcaaaaagcatccaaacgtgaattttggacatattggagtgtattgggtgcgttcgtggcaaaaactcacttcgtgattcgcgcgggcaacttttgtcaattaatgccattattggcatatattgagcccccacgggtgcgatgtttttgactggattcaaaaagttcaaaaagcatccaaacaggatttttggacatattggaatgtattgggtccgttcgtggtaaaaaatcacttcatgattcacgcggcgaacttttgtcaattaatgcaaatattagcataaattggcccacacgggtgcgatgtttttgaccggattaaataagttcaaaaagcaccaaaacatgaattttggacatattggagtgtattgggtgcgttcgtggcaaaaactcactccgtgattcgcacgacgaacttttgttaattaatgccaatattggcatatcttgagcccgcacgggtgcgatgttttttgaccggaatgaaaaagttcaaaaagcaccaaaacatgatttttggacatattggagtgtattgagtgcgttcgtggcaaaaactcacttcgtgattcgcgcggcgatcttttgtcaattaatgtcaatattggcatttattgagcccccacgggtgcgatgtttttgaccggattgaaaaagttcaaaaagcatccaaacatgatttttggacatattggagtgtattgggtgagttcgtggcaaaaactcacttcgtgattcgtgcggcgaacttttgtcaattagtgcaaatattagcatatattggcccacacgagtgcgatgtttttgaccggaatgaaaaagtttaaaaagcaccaaacatga

SEQ ID NO: 108878 - DNA, 4493 bp, Oryza sativa
aaaaagttgaaaagcatcccaacttgatttttggatatattggagtgtactgggtgcgttcgtggtaaaaactcccttcgtgattcgcgcgggtacttttgtcatttaatatcaatattggcatatgttgagaccccacgggtgcgatgtttttgaccggattgaataagttcaaaaagcatccaaacatgatttttggacatattggagtgtattgggtgcgttcgtggcaaaaactcacttcgtgattcgcacggcgaacttttgtcaattaatgccaatattggcatatattgagcccccacgggtgcgatgtttttgactggattcaaaaagttcaaaaagcatccaaacataatttttggacatattggagtgtattgggtgcgttcgtggcaaaaactcacttcgtgatttgcgcgacgaactattgtcaattaatgccaatattggcatatgttgagaccccacgggtgcgatgtttttgaccggattgaataagatcaaaaagcatccaaacttgaattttggacatattggagtgtattgggtgcgttcgtggcaaaaactcacttcgtgattcgcgcggcgaacttttgtcaattaatgccaatattggcatatattgagcccccacgggtgcgatgtttttgactggattcaaaaagttcaaaaagcatccaaacataatttttggacatattgtagtgtattgggtgcgttcgtggcaaaaactcatttcgtgatttgcgcgccgaactattgtcaattaatgccaatattggcatatgttgagaccccacgggtgcgatgtttttgaccggattgaataagatcaaaaagcatccaaacttgaattttggacatattggagtgtattgggtgcgttcgtggcaaaaacgcacttcgtgattcgcgcggcgaacttttgtcaattaatgccaatattggcatatattgagcccccacgggtgcgatgtttttgactggattcaaaaagttcaaaaagcatccaaacttgatttttggatatattggagtgtactgggtgcgttcgtggtaaaaactcacttcgtgattcgcgcgggtacttttgtcatttaatatcaatattggcatatgttgagaccccacgggtgcgatgtttttgaccggattgaataagttcaaaaagcatccaaacatgaattttggacatattggagtgtattgggtgcgttcgtggcaaaaactcacttcgtgattcgcgcggcgaacttttgtcaattaatgccaatattggcatatattgagcccccgcgggagcgatgtttttgactggattcaaaaagttcaaaaagcatccaaacataatttttggacatattgtagtgtattgggtgcgttcgtggcaaaaactcatttcgtgatttgcgcgtcgaactattgtcaattaatgccaatattggcatatgttgagaccccacgggtgcgatgtttttgaccagattgaataagatcaaaaagcatccaaacttgaattttggacatattggagtgtattgggtgcgttcgtggcaaaaacgcacttcgtgattcgcgcggcgaacttttgtcaattaatgccaatattagcataaattggcccacacgggtgcgatgtttttgaccggattgaaaaagttcaaaaagcatccaaacatgatttttgtacttattggagtgtattggatgcgttcgtggcaaaaactcactccgtgattcgcacgacgaacttttgtttattaacgccaatattggcatatcttgagcccccacgggtgcgatgtattttgaccggaataaaaaagttcaaaaagcacgaaaacatgatttttggacatattggagtgtattgggtgcgttcattgctaaaactcccttcgtgattcgcgcgacgaacttttgtcaattaatgccaatattggcatatgttgagcccccacgggtacgatgtttttgatcggattaaataagtttaaaaagcaccaaaacatgatttttgaacttattggagtgtattgggtgcgttcgtggcaaaaactcgctccgtgattcgcacgacgaacttttgtcaattaatgcccatattggcatatattgagccccccacgggtgcgatgttttttgaccggaatgaaaacgttcaaaaagcacccgaacatgatttttggacatattggagtgtattgggcgtgttcgtggtaaaaactcacttcgtgattcgcgcggcgaactttcgtcaattaatgccaatattggcatatgttgagcctccagggttgtgatgttttctgacaggaataaaaaagtttaacagcaccaaagcatgatttttggacatattggagcgtattgggtgcgttcgaggcaaaaactcacttcttgaatcgcacggcgaacttatgtcaattagtgccaatattgggtacgttcgtggcaaaaactcacttcgtgattcgtgcggcgaactttcgtcaattagtgccaatattggcacacgagggtgcgatgtttttgaccggaacgaaaaagttcaaaaaatgccaaaacatgatttttgcacatattctagtgtattgggtgcgttcgtggaaaaaactgtcttcgttattcgcgcggcgaacttttgtcaattaatgccaatattggcacacgagggtgagatgtttttgaccggaatgaaaaaagttcaaaaaatgtcaaaacatgatttttgcacatattctagtgtattgggtgcgttcgtggcaaaaactcacttcgtgattcgcgcaacaaactttttttaattagtgtcaatattagcatatattggcccacacgggtgcgatgtttttgttcgtgattcgcacggcgaacttttgtcacttaatgccaatattggcaaatattgagcccccactgctgcgatgtttttgactggattgaaaaagttcaaaaagcatccaaacataatttttggacatattggagtgtattgggtgctttcgtggtaaaaactcacttcgtgattcgtgcgacgaacttttgtcgattaatgcgaatattggcatatgttgagcccccacgggtaagatatttttgaccggattgaaaaagtacaaaaagcgcaaaaacatgatttttggacatattggagtgtactgggttcgtttgtggaaaaaactcacttcgtgattcgcgcgacgtacttttgtgaattaatgccaatattggcatatattgagccccccacgggtgcgatgttttttgaccggaataaaaaagttcaaaaagcaccaaaacatgatttttgaatattttggagtgtattgggtgtgttcgttgctaaaactcccttcgtgattcgcgcgacgaacttttgtcaattaatgccaatattggcatatgttgagcccccacgggtacgatgtttttgaccggattaagtaagtttaaaaagcaccaaaacatgatttttgtacttattggagtgtattgggtgcgttcgtggcaaaaactcactccgtgattcgcacgacgaacttttgtcaattaatgccaatattggcatatattgagccccccacatgtgcgatgttttttgaccggaataaaaaagttcaaaaagcaccaaaacatgatttttggacttattggagtgtattgggtgcgttcgtggcaaaaactcacttcgtgattcgcgcggcgaacttttgtcaattaatatcaatattggcatatattgagcccccacgagtgcgatgtttttgaccggattgaaaagttcaaaaagcaccaaaacatgatttttggacttattggagtttattgggtgcgttcgtggcaaaaactcacttcgtggttcgcaccgcgaacttttgtcaattaatgccaaaattggcaaaagttgagcccccacggctgcgatgtttttggctggattgaaaaagttcaaaaagcatccaaacataatttttggacatattggagtgtattgggtgcgttcgtggcaaaaactcacttcgtgattggcgcgacgaactattgtcaattaatgccaatattggcatatgttgagcccccacgggtaagatatttttgaccggattgaaaaagtacaaaaagcgcaaaaacatgatttttggacatattggagtgtactgggttcgtttgtggaaaaaactcacttcgtgattcgcgcgacatacttttgtgaattaatgccaatattggcatatattgagccccccacgggtgcgatgttttttgaccggaataaaaaatttcaaaaagcaccaaaacatgatttttgaatattttggagtgtattgggtgtgttcgttgctaaaactcccttcgtgattcgcgcgacgaacttttgtcaattaatgccaatattggcatatgttgagcccccacgggtacgatgtttttgaccggattaagtaagtttaaaaagcaccaagacatgatttttgaacttattggag

SEQ ID NO: 108879 - DNA, 858 bp, Oryza sativa
cccccacgggtgcgatgtattttgaccggaataaaaaagttcaaaaagcacgaaaacatgatttttggacatattggagtgtattgggtgcgttcattgctaaaactcccttcgtgattcgcgcgacgaacttttgtcaattaatgccaatattggcatatgttgagcccccacgggtacgatgtttttgaccggattaagtaagtttaaaaagcaccaaaacatgatttttgtacttattggagtgtattgggtgcgttcgtggcaaaaactcactccgtgattcgcacgacgaacttttgtcaattaatgccaatattggcatatattgagccccccacaggtgcgatgttttttgaccggaataaaaaagttcaaaaagcaccaaaacatgatttttggacttattggagtgtattgggtgcgttcgtggcaaaaactcacttcgtgattcgcgcggcgaacttttgtcaattagtgccaatattggtatatattggcctacacaggtgcgctgtttttgaccggaatgaaaaagttcaaaaagcaccaaaacatgatttttggacatattggagtgtattgggtgcgttcgtggcaaaaactcacttcatgattcgcgcggcgaacttttgtcaattaatgccaaaattggcaaaagttgagcccccacggctgcgatgtttttggctggattgaaaaagttcaaaaagcatccaaacataatttttggacatattggagtgtattgggtgcgttcgtggcaaaaactcacttcgtgattggcgcgacgaactattgtcaattaatgccaatattggcatatgttgagaccccacgggtacgatgtttttgacc

SEQ ID NO: 108880 - DNA, 1471 bp, Oryza sativa
attcgcccggtgaacttttgtcaattaatgccaatattggcacacgagggtgcgatgttttgtactggaatcaaaaagttcaaaaagagccaaaacatgatttttggacatattggagtgtatctggtgcattcgtggcaaaaactcacttcgtgattcgcgcggcgaactttgtcaattaatgccaatattggcacacgagggtgcgatgttttctactggaatcaaaaagttcaaaaagagccaaaacatgatttttggacatattggagtgtattgggtgcattcgtggcaaaaactcacttcgtgattcgcgcggcgatctattgtcaattaatgccaatattggcacacgagggtgcgatgttttctactggaatcaaaaagttcaaaaagagccaaaacatgatttttggacttattggtgtgtatcgggtgtgttcgtggcaaaaacacatttcgtgattcgcgtggcttacttttgtcaaataatgtcaatattggcatatattagcccacacgggtgcgatgtttttgaccagaatgaaaatgttcaaaaaacaccaaagcatgatttttggacttattggagtgtattgggtgcgttcgtggcaaatactcaattcatgattcgcgcggcgaacttttgtcaattaatgccaatattggcacacgagggtgcgatgttttctactggaatcaaaaagttcaaaaaacgccaaaacatgatttttggacatattggagggtattgggtgcgttcgtggcaaaaacacacttcgtgattcgcgcggcgatcttttgtcaattaatgccaatattggcacacgagggtgcgatgttttctactggaatcaaaaagttcaaaaaacgccaaaacatgatttttggacatattggagtgtatcgggtgtgttcgtggcaaaaacacatttcgtgattcgcgtggctaacttttctcaaataatgtcaatattggcatatattagcccacacgggtgcgatgtttttgaccagaatgaaaaagttcaaaaacgccaaaacatgatttttggaaatattggagtgtactgggtgcattcatggcaaaaagtcacttcgtgattcgcgcggcgaacttttgtcaattaatgccaatattggcacacgagggtgcgatgctttctactggaatcaaaaagttcaaaaagagcccaaacatgatttttggacatattggagtgtatcgggtgggttcgtggcaaaaacacatttcgtgattcgcgtggcgaacttttgtcaaataatgtcaatattggtatatattggcccacacgggtgcgatgtttttgaccggaatgaaaatgttcaaaaagcaccaaagcatgatttttggacatattggagtgtattgggtgcgttcgtggcaaaaactcacttcgtgattcgcgcggcgaacttttgtcaattaatgccaatattggcacacgag

SEQ ID NO: 108881 - DNA, 1417 bp, Oryza sativa
cttttttattccggtcaaaaaacatcgcacccgtggggggctcaatatatgccaatatgggcattaattgacaaaagttcgtcgtgcgaatcacggagtgagtttttgccacgaacgcacccaatacactccaataagtaaaaaaatcatgttttggtgctttttaaacttatttaatccggtcaaaaacatcatacccgtgggggctcaacatatgccaatattggcattaattgacaaaagttcgtcgcgcgaatcacgaagggagttttagcaacgaacgcacccaatacactccaatatgtccaaaaatcatattttggtgctttttgaacttttttattctggtcaaaaaacatcgcactagtggggggctcaatatatgccaatattggcattaattcacaaaagatcgtcgcgcgaatcacgaagtgagttttttccacgaacgaacccagtacactccaatatgtccaaaaatcatgtttttgtgctttttgtactttttcaatccggtaaaaaatatcgcacccgtgggggctcaacatatgccaatattcgcattaattgacaaaagttcgtcgcacgaatcacgaagtgagtttttaccatgaaagcacccaatacactccaatatgtccaaaaattatgtttggatactttttgaactttttcaatccagtcaaaaacatcgcagccgtgggggctcaatatttgccaatattggcattaattaacaaaagttcgccgtgcgaatcacgaacaaaaacatcgcactcgtgtgggccaatatatgctaatatttgcactaattgacaaaagttcgccgcacgaatcacgaagtgagtttttgccacgaacgcacccaatacactagaatatgtgcaaaaatcatgttttgacattttttgaacttttttcattccggtcaaaaacatctcaccctcgtgtgccaatattggcattaattgacaaaagttcgccgcgtgaataacgaagagagttttttccacgaacgcacccaatacactagaatatgtgcaaaaatcatgttttggcattttttgaactttttcgttccggtcaaaaacatcgcaccctcgtgtggcaatattggcactaattgacaaaagttcgccgcacgaatcacgaagtgtgtttttgccacgaacgaacccagtacactccaatatgtccaaaaatcatgttttaatgctttttcattccggacaaaaacatcgcacccgtgtgggcctatatatgctaatattggcactaattgacaaaagttcgtcgcgcgaatcacgaagagagttttttccacgaacgcacccaatacactagaatatgtgcaaaaatcatgttttgacattttttgaacttttttcattccggtcaaaaacatctcaccctcgtg

SEQ ID NO: 108882 - DNA, 705 bp, Oryza sativa
gggctcaacatatgccaatattggcattaactgacaaaagttcgccgcgcgaattacgaagtgagtttttgccacgaacgcacccaatacactccaatatgtccaaaaatcatgttttggtgctttttgaactttttcattccgaacaaaaacatcgcacccgtgtgggccaatatatgcaaatattgacattaattgacaaaagttcgccgcgcgaatggtgccaatacactagaaaatgtgcaaaaatcatgttttggcgtttttcgatctttttcattccggtcaaaaacaacgcaccctcgtgtgccaatattggcattaattgacaaaagttcgtcgcgcgaatcacgaagtgagtttttgccacgaacgcacccaatacactgcaatatgtcagaaaatcatgtttttgtgctttttgaactttttcattccggtcaaaaacatcgcacccgtgggggctcaacatatgccaatattgacattaattcacaaaagttcgccgcgcgaaccacgaagtgagttttttccactaacggtgccaaaacactagaatatgtgcaaaaatcatgttttggcgttttttgaactttttcattccggtcaaaaacaacgaaccctcgtgtgccaatattggcactaattgacaaaagttcgccgcgcgaatcacgaagtaagtttttgccacgaacgcacccaata

SEQ ID NO: 108883 - DNA, 640 bp, Oryza sativa
gttgtttttgcccgaaatgaaaaagatcgaaaaacgccaaaccataatttttgcacattttttagtgtattggccccattcgtgaaaaaagctcattcgggattcgcgcggcgaagttttgtcaattaatgccaatattggcatataatgagcccccccgggtgcaatgttttatgtccggaatgaaaaagtttcaaaaggcaccaaaacatgatttttggacatattggagtgtattcggtgcgttcgtggcaaaaactcacttcgtgattcgggcggagaacttttgtcaattaatgccaatattggcacatattgagcccccacgggtgctatgttttatgaccggaatgaaaaagttcaaaaggcaccaaaacatgatttttggacatgttggagtgtattgggtgcgttcgtggcaaaaactcacttcgtcattccgatggagaacttttgtcaattaatgtaaatattggcatatattgagcccccacgggtgcaatgttttatgaccggaatgaaaaagttcaaaaggcaccaaaacatgatttttggacatattggagtgtattgggtgcgttcgtggcaaaaactcacttcgtgattcgcgcggcgaacttttgtcaattaatgccaatat

SEQ ID NO: 108884 - DNA, 659 bp, Oryza sativa
gcatatgttgagcccccacgggtacgatgtttttgaccggattaaataagtttaaaagcgcacaaacatgatttttgtcttattggagtgtattgggtgcgttcgtggcaaaaactcactccgtgattcgcacgacgaacttttgtcaattaatgccaatattggcatatcttgagcccccacgggtgcgatgttttttgaccggaatgaaaaagttcaaaaagcaccaaaacatgatttttggacatattggagtgtattgggtgcgttcgtggcaaaaactcactccgtgattcgcacgacgaacttttgtcaattaatgccaatattggcatatcttgagcccccacgggtgcgatgttttttgaccggaatgaaaaagttcaaaaagcaccaaaacatgatttttggacatattggagtgtattgggtgcgttcgtggcaaaaactcacttcgtgattcgcgcggcgaacttttgtcaattatgtcatattggcatatattgagcccccacgggtgcgatgtttttgaccggattgaaaaagttcaaaaagcatccaaacattatttttggacaaattggagtctattgggtgcgttcgtggcaaaaactcacttcgtgatttgcgcggcgaacttttctgaattaatgccaata

SEQ ID NO: 108885 - DNA, 1105 bp, Oryza sativa
aaagtgagtttttgccacgaacgcacccaatacattccaatatgtccaaaaatcatgttttggctctttttgaactttttgattccagtagaaaacatcgcaccctcgtgtgccaatattggcattaattgacaaaagttcgccgcgcgaatcacgaagtgagtttttgacgcacccaatacactccaatatgtccaaaaatcatgctttggtgctttttgaatattttcattacggtcaaaaacatcgcacccgagtgggccaatatatgccaatgttgacattatttgacaaaagttcgccacacgaatcacgaaatgtgtttttgccacgaacccacccgatacactccaatatgtccaaaaatcatgttttggctctttttcaactttttgattccagtagaaaacatcgcaccctcgtgtgtcaatattggcattaattgacaaaagttcgccgcgcgaatcacaaagtgagtttttgccacgaacgcacccaatacactgcaatatgttcaaaaatcatgctttgatgcgttttgaacattttcattccggtcaaaaacatcgcacccgtgtgggccaatatatgccaatattgacattatttgataaaagttcgccacgtgaatcacgaaatgtgtttttgccacgaacacacccgatacactccaatatgtccaaagatcatgttttggctctttttcaactttttgattccagtagaaaacatcgcaccctcgtgtgccaatattggcatttattgacaaaagatcgccgcgcgaatcacgaagtgagtttttgccacgaacgcacccaatacactccaatatgtcgaaaaatcatgttttggctctttttgaactttttgattccagcagaaaacatcggaccctcgtgtgccaatattggcattaattgacaaaagttcgccgcgagaatcacgaagtgagtttttgccacaaacgcacccaatacactccaatatgtccaaaaatcatgctttggagctttttgaacattttcattccggtcaaaaacatcgcaaccgtgtgggccaatatatgccaatattgacattatttgacaaaagttatccacgcgaa

SEQ ID NO: 108886 - DNA, 721 bp, Oryza sativa
aaacaaaagttcgtcgtgcgaatcacggagtgagtttttgccacgaacgcatccaatacactccaataagtacaaaaatcatgtttggatgctttttgaactttttcaatccggtcaaaaacatcgcacccgtgtgggccaatttatgctaatattggcattaattgacaaaagttcgccgcgcgaatcacgaagtgcgtttttgccacgaacgcacccaatacactccaatatgtccaaaattcaagtttggatgctttttgatcttattcaatctggtcaaaaacatcgcacccgtggggtctcaacatatgccaatattggcattaattgacaatagttcgacgcgcaaatcacgaaatgagtttttgccacgaacgcacccaatacactacaatatgtccaaaaattatgtttggatgctttttgaactttttgaatccagtcaaaaacatcgctcccgcgggggctcaatatatgccaatattggcattaattgacaaaagttcgccgcgcgaatcacgaagtgagtttttgccacgaacgcacccaatacactccaatatgtccaaaattcaagtttggatgctttttgaacttattcaatccggtcaaaaacatcgcacccgtggggtctcaacatatgccaatattggcattaattgacaatagttcgtcgcgccaatcacgaagtgagtttttgccacgaacgcacccaata

SEQ ID NO: 108887 - DNA, 922 bp, Oryza sativa
taagtttataaagcaccaaaacataatttttgtacttattggagtgtattgggtgcgttcgtggcaaaaactcactccgtgattcgcacgacgaacttttttcaattaatgccaatattggcatatcttgagcccccacgggtgcgatgttttttgaccggaatgaaaaagttcaaaaagcaccaaaacatgatttttggacatattggagtgtattgggtgcgttcgtggcaaaaactcacttcgtgattcgcgcggcgaacttttgtcaattaatatcaattttggcatatattgagcccccacgggtgcgatgtttttgaccggattgaaaaggttcaaaaagcatccaaacatgatttttggacatattggagtgtattgggtgcgttcgtggcaaacactcacttcgtgattcgtgcggcgaacctttgtcaattagtgccaatattagcatatattggcccacacgggtatgatgtttttgaccggaatgaaaaagtttaaaaagcaccaaaacatgatttttggacatattggagtgtattgggtgcgttcgttgctaaaactcccttcgtgattcgcgcgacgaacttttgtcaattaatgccaatattggcatatgttgagcccccacgggtacgatgtttttgaccggattaaataagtttaaaaagcaccaaaacatgatttttggacatattggagtgtattgggtgcgttcgtggcaaaaactcactccgtgattcgcacgacgaacttttgtcaattaatgccaatattggcatatcttgagcccccacgggtgcgatgtttttgaccggaatgaaaaagttcaaaaagcaccaaaacatgatttttggacatattggagtgtattggggtgcgttcgttggtaaaaaacccttcgtgattcgcgcga

SEQ ID NO: 108888 - DNA, 1063 bp, Oryza sativa
  unsure (1)..(1063): unsure at all n locations
catgatttttggacatattggagtgtattgggtgcgtttgtggcaaaaactcacttcgtgattctcgcggcgaacttttgtcaattaatgccaatattggcacacgagggtccgatgttttctgctggaatcaaaaagttcaaaaagcgccaaaacatgatttttggacatattggagtgtattgggtgcattcatggcaaaaactcacttcgtgattcacgcggcgaacttttgtcaattaatgccaatattggcacacgagggtgcgatgttttctactggaatcaaaaagttcagaaagagccaaaacatgacttttggacatattggagtgtatcgggtgtgttcgtggcaaaaacacatttcgtgattcgcgtggctaacttttgtcaaataatgtcaatattggcatatattggcccacacggttgcgatgtttttgaccggaatgaaaatgttcaaaaagcaccaaagcatgatttttggacatattggagtgtattgggtgcgtttgtggcaaaaactcacttcgtgattcgcgcggcgaacttttgtcaattaatgccaatattggcacacgagggtgcgatgttttctgctggaatcaaaaagttcaaaaagagccaaaacatgatttttggacatattggagtgtattgggtgcgttcgtggcaaaaactcacttcgtgattcgcgcggcgaacttttgtcaattaatgccaatattggcacacgagggtgcgatgttttctactggaatcaaaaagttcaaaaagagccaaaacatgatttttggacatattggagtgtatcgggtgtgttcgtggcaaaaacacatttcgtgattcgcgtggctaacttttgtcaattaatgccaatattggcacacgacaagggtgcgatgttttgtactgtaatcaaaaaattcataaagacccaaagcatgatctttggacatattggagtgtattgggtgcgtttgtggcanatactcacttcgtgattctcgcggcgaacttttgtcaattaatgccaatattggcacacgaaggtccgatgttt

SEQ ID NO: 108889 - DNA, 874 bp, Oryza sativa
tcctgcagccccgaatcacgaagtgagtttttacgcacccaatacactccaatatgtccaaaaatcatgctttggtgctttttgaacattttcattctggtcaaaaacatcgcacccgagtgggccaatatatgccaatgttgacattatttgataaaagttcgccacacgaatcacgaaatgtgtttttgccacgaacccacccgatacactccaatatgtccaaaaatcatgttttggctctttttcaactttttgattccagtagaaaacatcgcaccctcgtgtgtcaatattggcattaattgacaaaagttcaccgcgcgaatcacaaagtgagtttttgccacgaacgcacccaatacactgcaatatgttcaaaaatcatgctttggtgcttgttgaacattttcattccggtcaaaaacatcgcaaccgtgtgagccaatatatgccaatattgacattatttgacaaaagttagccacgcgaatcacgaaatgtgtttttgccacgaacacacccgatacactccaatatgtccaaaagtcatgttttggctctttctgaactttttgattccagcagaaaacatcgcaccctcgtgtgtcaatattggcattaattgacaaaagttcgccgcgcgaatcacaaagtgagtttttgccacgaacgcacccaatacactgcaatatgttcaaaaatcatgctttggtgctttttgaacattttcattccggtcaaaaacatcgcaaccgtgtgggccaatatatgccaatattggcattaattgacaaaagttcgccgcgcgaatcacgaagtgagtttttgccatgaatgcacccaatacactccaatatttccaaaaatcatg

SEQ ID NO: 108890 - DNA, 1081 bp, Oryza sativa
gcgaacatttgtcaattaatgccaatgttggcacacgggggtgcgatgtttttgaccagaatcaaaatgttcaaaaaaacggcaaaacaagatttttggatatattggagtgtgttgcgtgcgttcgtggcaaaaactcacttcgtgatttgcgcggcgaacttttgtcaattaatggcaacattggcacacgagggtgcgatgtttttgaccggaatcaaaaagttcaaaaacgccatttttggacattttggagtgtattgcgtgcgttcgtggcaaaaactcacttcatgattcgcacggcgaacttttctcaattaatgcgaatattggcacacgagggtgcgatgtttttgaccggaatcaaaaagttcaaaaaatgccaaaacatgatttttggacatattggagtatgttgcgtgcgttcgtggcaaaaactcacttcgtgattcgcgcggcgaacttttgtcaattaatggcaacattggcacacgggggtgcgatgtttttcaccggaataaaaaagctcaaaaaacgccaaaacatgatttttggacatattggagtgtattgggtgcgttaatggcaaaaactcaattcatgatttacacggcgaacttttatcaattaatgccaatattggcatattttggcccaaataggggcgatgtttttgaccggaatgaaaatgttcaaaaagcgctaaaacatgatttttggacatattggagtgtattgggtgcgttcatagcaaaaactcacttcgtgattcgcgcggcgaacttttgtcaattaatgccaatattggcacacgaaggagcgttgcttttgaccggaatcaaaaagttcaaaaaacgccaaaacatgatttttggacatattggagtgtattgggtgcgttcgtggcaacaactcacttcgtgattcgcgcggcgaacttttgtcaattaatgccaatgttggcacactagggtgcgatgtttttgaccggaatcaaaaagttcaaaaaacgccaaaacaagatttttggacatattggagtgtattgggtgcgttaatggcaaaaactcaattcgtgatt

SEQ ID NO: 108891 - DNA, 1069 bp, Oryza sativa
gaatcacgaagtgagtttttgccacgaacgcacccaagacactccaatatgtgcaaaaatcatgtcttggtgcattgtgaactttttcattccggtcaaaaacatcgcacccgtgtgggccaaaatataccaatattgacattatatgacaaaagttcgccgcgcgaatcacgaaatgtgttttcgccacaaacacacccgatacactccaatatgtccaaaaatcatgttttggcgttttttgaactttttgattccggtcgaaaacatcgcaccctcgtgtgccaacattggcattaattgataaaagttcgccgcgcgaatcacgaagtgagtttttgccatgtatgcacccaatacactccaatatgtccaaaaatcatgttttggcgttttttgaactttttgattccggtcaaaaacatcgcaccctcgtgtgccaatattggcattaattgacaaaagttcgccgcgcgaatcacgaagtgagtttttgccatgtatccacccgatacactccaatatgtccaaaaatcatgttttggtgtttcttgaactttttgatgcctatagaaaacatcgcaccctcgtgtgccaatattggcattaattgacaaaagatcgccgcgcgaataacgaagtgagtatttgccacgaacgcacccaatacactccaatatgtccaaaaatcatgctttggtgctttttgaatattttcattctggtcaaaaacatcgcacccgtgtggtccaaaatatgctaatgttggcattaattgacaaaagttagccacgcgaatcacgaaatgtgtttttgccacgaacacacccgatacacaccaatatgtccaaaaatcatgttttggctctttttgaactttttgattccagtagaaaacatcgcaccctcgtgtgccaatattggcattaattgacaaaagatcgccgcgcgaatcacgaagtgagtatttgccacgaacgcacccaatacactccaatatgtccaaaaatcatgctttggtgctttttgaacattttcattctggtcaaaaacatcgcacccgtgtggg

SEQ ID NO: 108892 - DNA, 1178 bp, Oryza sativa
tgggtgcgttcgtggcaaaaactcacttcgtgattcgcgcggggaacttttgtcaattaatgccaatattggcatatattgagcccccacgggtgcgatgtttttgactggattcaaaaagttcaaaaagcatccaaacaggatttttggacatattggaatgtattggttgcgttcgtggtaaaaaatcacttgatgattcacgcggcgaacttttgtcaattaatgccaatattagcataaattggcccacacgggtacgatgtttttgaacggaatgaaaaagttcaaaaagcaccaaaacattatttttggacaaaaactcacttcgcgattcgcgcggcgaacttttctgaattaatgccaatactggcacacgagggtgcgatgtttttgacaggaatgaaaaagttcaaaaagcaccaaaacatgatttttggactttttggagtgtattgggtgcgttcgtggcaaaaactcacttcgtgatttgcgcggcgaacttttgtcaattaatatcaatattggcatatattgagcccccacgggtgcgttgttttcgaccagattgaaaaagttcaaaaagcatccaaacatgatttttggacatattggagtgtattgggtgcgttcgtggcaaaaactcacttcgtgattcgtgcggcgaacttttgtcaattaatgccattattggcatatattggtacacgtgggtatgatttttttgaccggaatgaaaaagtttaaaaaccacaaaaccatgatttttagacatattggagtgtattgtgtacgtccgtgtcgaaaaatcacttcgtgactcgtgcggctgatgaaccctgagttccacatgacactcaaagctgttgttggcccgatctttcgatgagttgagataactacgatttgggagaaacgttgacgacccgactacaaccgtacaagacgttgtgttgcgccttagcgatcgatacacctctccgtaggttgttgatcttgccggtgcaaagcaaccctattcctgcaagcaaatcgaagaaacaagcaagaacaagataaaagcaatttgaattgcaactaggaatgaatgcacacaataagttggggtttcggatacaagcagatggacggtctagccgacacgcgcgctgcaaggaagtagcaatggctaaactttc

SEQ ID NO: 108893 - DNA, 1293 bp, Oryza sativa
aaacttgggcttgggccttgtatcattacagcccattaggggtccacaaaacctagggtttgctcccacctcctctcctggtcattcctccacctatataaactcctagcagccaccattttgcactttgggttttgttttgatgtaagtttagctgcagctacttccttgtactcgcgtgtgtcggctagaccacccggatacttgtattcagaaccccattttggtttgtttaagtttcatcatttgacaagtgccgtgagctgtttccttgtcaacttgttcttgcttgttcttcgattgcttgcaggttcaaggttgttcttggcacggcaagaacagcaacaacgtggagtcggtgtaccggttgctaaggcgcagcacccctgtggtagttgtagtcagaccgccaacgtcgtatccttccccaaatcgaagtttaccctcctctcatcgaaagatcgggaacccccgttgctgcatcatgccaatattggcattaattgacaatagatcgccgcgcgaatcacgaagtgagtttttgccacgaacacacccgatacactccaatatgtccaaaaatcatgttttggctctttttgaactttttgattccagtagaaaacatcgcaccctcgtgtgccaatattggcattaattgacaaaagttcgccgcgcgaatcacgaagtgagtttttgccacgaatgcacccgatacactccaatatgtccaaaaatcatgttttggctctttttgaactttttgattccagtacaaaacatcgcaccctcgtgtgccaatattggcattaattgacaaaagttcaccgcgcgaatcacgaagtgagtttttgccacgaacgcacccaatacactccaatatgtccaaaaatcttgttttggctctttttgagctttttgattccagtacaaaacatcgcaccctcgtatgccaatattggcattaattgacaaaagttcgccgcgcgaatcacgaagtgagtttttgccacgaacgcacccagtacactccaatatgtccaaaaatcatgctttggtgctttttgaacattttcattccggtcaaaaacatcgcacccgtgtgggccaatatgtgccaatattgacattatttgacaaaagttagccacgcgaatcacgaaatgtgtttttgccacgaacacacccgatacacaccaatatgtacaaaaatcatgttttggctctttttgaactttttgattccagtagaaaacatcgcaccctcgtgtgccaatattggcattaattgac

SEQ ID NO: 108894 - DNA, 784 bp, Oryza sativa
gggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggg

SEQ ID NO: 108895 - DNA, 730 bp, Oryza sativa
aattcctgcagcccggcttcgcacgttgccactctgcccaccgtcgccccacttcgcctgcttgctctacccgccggcttcatgcggcgccgctccgcctattctgctcccctctggtcggctgctcccatgggagagagcggacagatacagagaagagaggggatgagagaggagaggatagaggaagagaggttgaaaggggaggggaagaagaggctgacgtgtggcggtgtgggacccacgtgggtagaagaaaatcgattgggattgagacagagagggggggggacctggagagacgcgcgtggtaaaggaataggttggttgtatgtacagaaagtggttggcatgctagctgtacggtggaagcaaaccattatggcttgccattgacttctttttaatttccttgagaaatagacaaaaatttaaccagatcctcctcagcaccgtagagggaaggtctcctcgccaccttgctaatgggctcgtggatctgggccgacgatggccggatccgtcatcctgcctcgtcacatggtgtcatcagggatgatggagacggcggcggtggagcgaagcagtcgtcaatgctagctacgaagaggtccatcatagataccggctacgaggtggagataaaatcagaaaaaaaaaagatgaacggattgtggatagcgcattacctggtcgtcgtagggagagaaccaccggtagcaactgcggc

SEQ ID NO: 108896 - DNA, 664 bp, Oryza sativa
aattttacacgtggtattttttggacatttcagcagatgtttcactagatcatttaggatcttgcacgtattgttctttcaatatttcaatgtatattttgtattgttttagaggtcacaaatcaatgtcccacttataataaaaatgtttcaattagtaatataattacatatgttttatttctccaaaatataatcatgtgagatctctttgtaaagatttaattgcaacaaattcaatggtgcaattgaatcacaaattggataagtatttcataagaaaaaatggtttataatttgctaattaagagtatgggagaagagacaaggggatgggagaagtttgcatgtacctcacatgtggaagagaagaaatgactgcgtgcatgcatgtggaggtttcccagaagaaaagattgcatgcatgcttagggggcccaatttttttctccaaaaatcgggcacccgttccgtagtgtcctccataaaaatcttcaatctccaaacaacatcatgtagtaccctcgatagaaaagagatgaaccatacttcaaacttaccattggtgtgaacttagcatagacacgaaacatgatgcacaaacttcaaactcgctattggaataaaatcctgaatatgctgccataaatttatgtaaccctag

SEQ ID NO: 108897 - DNA, 523 bp, Oryza sativa
ccaggctagattaattaaacattttcttatttgacttcccttttgtttaagaggtcctgttgactggttgggaagcagctaacctacgttcatcccagccgtgtgtcagatcacgtcaactactgggcctatcaattggcaggtgcaaagcgagcgaccaatagactagcaaccccgaaaatttccatgtacatgcatggatctaaacaaatgtgtttcaacatgtttttggaccccatttttcaaaagttctcatctgcactctctattgatttggctagaacaaatttatttttttctcccataagtgttcgatgataatcatgtcaactgcaaatcagtactacaaaaagacacataaaagtcagtattataggtgccggaataactaaaaccggcacctattatgcttttcccaccaccggagcgcccgcggggggcgctaaagggaaaaattggcacctttaagtatttataagtgccgattttgaaaaaagtccgacaactatactatagatgctgg

SEQ ID NO: 108898 - DNA, 1342 bp, Oryza sativa
ttatttagcacacgctgaacagcattcttgattgactgcagctgcatatttccctcaattttttctgtagtttgtgaaactatatctcttccaattttttcaaggttgatattacccatggaaacatgaacccatatcctaaagctgaatacctctgttcctgtattattgaaaacgaactgtgctaggcttgtcttcccaaaacctacaggcccaactatggatataatggaaagctcttcagcgctgttttccattaaaatgtccatgagattatctaagtctgcatccctcccaacaattgcaatgtcagtatttctgtatgatgttgtttgcttctcctcaaaattcactgctgagttgatatgtgaaaggaaatgatactgattgggcaattgttgcctttgctgtaacatctccctcttggacttcatcttataaaccatgctacctttcagaagcattggattcgatagtgagcagaataatgacccctgtaaatttaccaacatatatacataaaagtagtctttatcatgaaatatattttatattttgataacgatgttgctggaagacaaaaaaggggacagctaaacaagagttggtgcatcaaggagccaaggaaggtaccagcccttacatagctgatagatacacaagtctttggtataaaccttgcattttctcatataatacgaaggacatttttttgcatgcctacaagtttctcatctctcactatctagtccccctcaagcaaatgtacagtctaaagataagttacgtgtaagtattcggcttatctcttactattaccaaataatttcttaacaaaaggaaggatgcttctaattatcgattgtgttgacttatataagctacgctagatgacaccctgtgcgttgctgcaggatgttggtgtgtaaagtgcaattgcaaaattgcaatatatggaactgacaaaatgattaatccaacaacccaaaaaagattgatgtaggctacaaagactgggctaatccaaacagttaccatcgaaggatgtcaaagataagatgatattgcttctttcagccccataggttgcccaaagaagaataagccaaagccaaaatttgaattttaaaacttaattttgaagttgatttttaagataagatattttcaacatattttttcagcattgacttttaaatcgctgagaacacatatataaaaattttacacaaattattatttggtcgctaataaaccattacagcttataatcagcttttgggcaacctatgagaccctttctttatacagcttataaaaaagaagaaaggaaaaattccca

SEQ ID NO: 108899 - DNA, 620 bp, Oryza sativa
ataataacacctctttgtttaggcttatataaactgatttataagctaagaagtttaagcataaacaaataagcaacatttttatttagcttttttaaagccaagccactcttaccttgttaaagaaaagactatgttggagtaactagctaactataatttcagacttaacccttaaaataaaaaattgtttgcaaataaagttacaaacagtatcaaggaagtgcattttgtgacttgccatcaacgaacggttgtgaatcaccgatgaaggactctaggtcctccaattcaatggtttcaaaacataacacacaaaacgagaaaaaagcataaggaaaaccaaataaatagtacataaaatgcatataaatatgttctttgtatttcagataaatggggtatagagactttttctttaaaaatatatatttggctaatgcgcattggaccgtgcatatgtgctgcgatccaggcacgagaagagagataaaaaataattacgacaaattcattgcaaccccaaggtaaaatagtttccataaaaaaattttacaccctatcacattgaacgtttggacacatgtatggagtattaaacatagataaaaaaactaatt

SEQ ID NO: 108900 - DNA, 504 bp, Oryza sativa
ttatgcttaatgtggagaagagaggagaggagatagaaaaaagtaggctatagattcattgttagttgtagtacgagttccaataaattatataagagataaatgtggggttgtattaatggtgtaatatatatatacagttaactattatatgtgggttattaagttaacttaagatgatgtgtgtaattttaaaagtgtaggatatatctttagttaactataatttgcttgggctattacgttaacttaaggcatatctcctctgcacgaaaaacggagcggtccattagcacgtgattaactaaatattagctattttttaaaaaaatagattaatttgattttttaagtaactttggtatagaaactttttgcaaaaacgtatcgtttagcaatgtgaaaaacgtacacacggaaaacgaggaattggggttgggaacaggctgtaacgaacgtagcattaagatgatgtgtgtaattttaaagttagtagttgactat

SEQ ID NO: 108901 - DNA, 777 bp, Oryza sativa
aaaattcaaatatgttttgtacgataaaaaaatattttttatctcttagtttatttcttgttaggaaagaaaaaaaggtaggattttcccttctctaattttatcggcactaataaaccgataaatcaacctaacatgtcaacgccacgtctcttctcaactgagctgcgcgttctcaccacatcacatcattatattaggtaattgagggaaaatgaaatagatacattagttttctattcatgacccatacagtagcagaaaccattagaaagatatgataatagagctaaaatgtctcatagatgaacgatacgagtatatctgtgacgacaactcgagcctgatcttgcctaccagccccttctatgttcttcagcgcgtattgaaatttcctgctgcttcattcgcatgtactctatttgtgtgttttagccttagttattttttggccatgataattcggactggcattgttggaccacatagtgaatccgtacatacttggattggcctgagaaataaatatagttagttaatgagggtaggtattgttggtagtcttaagatcacagataagtacttaaccacaccgttatagcacttccccttagagtattctaagggtatcgaacacgaggaacgatctataatcagcattcaatccaaggacaacagtctagaataaattggctagagaggattactatgtcttttaattagttaattaagttaacagtaaaagaaaaaaaagtacgaattacccccatggagtat

SEQ ID NO: 108902 - DNA, 733 bp, Oryza sativa
aatcataataggttacatctatcagattttatttcttgtggtttgttcacggtcctggtgagctcttactttgattttactttgttaattgttatatgattttggcttggccaattgtcatgattccggtatgttataccccatcttgtaaattatgcatttacctaactaatggtcgccacaattttttgttctgtgcgtgttatctgtaggaaaatttttgttagtagtattggctatatttaaatcatgccactgaaagattttgcagcaagggctggcccagtattcaactgaggagctttcttcaagagtttaattggttattgacccttatttagtaccttgggatattaaacaaagctgttgagcctttggaaattttacaaatggtgagcacatttgtatcacaggttttgggcagaatgcacattttcttattctgttaaaataacccactgattatatgacccagtgaaatgatctattctgccaggccagacaaaatgttaaaactctattatatgctattttttgttgcagcaatgttgcatcatggctcgtgtgatcatgtattcatgtccaagtgcctatccttttgcactatggcactacctcctccaatcactgccattgcctaggaaagacacataatgcatattatttttctactttatgcatgtaaacattaaggccaatactgacactttgggagaaccagatcgatgcattg

SEQ ID NO: 108903 - DNA, 720 bp, Oryza sativa
acgaagataccttttcttttacaaagaaattcagcaagcatgaaccaaattgtgagagctagaagctccgcctgcttctccagtgcccgccataccacccgtcaccgccaccgttccaaccccgttccccgtagatggccaaggggaagagaaagagaggaggaggaggaagaagggttggatagaggatgacatgtggacccaacatgttagtgagtcccattgtagtttttgtgtgaatgacaaatgggtcccacatacttttaatttctaatgtcacaaaagtgccacgtcaatgccacgtggggcgaagaccaagtcagcaccgccacgtcagcgaaaccaccctccaagaccgtaagagagtcaaattacgtcgatttaatagtttaggggagtcgtcctacccaatttattttaaggggtataaattagatacggtttattttaagagagtcgaagtggacttttttcttgatatgatctcgtctttgccgtggaccttcatctacccacctatactcataaatcacctgggcttgcaagctactccctccgtccaaaaaaatacaaaccctggtttccgtgcccaatgtttgaccgtccgtcttatttgaaaaaattatgaaaaaaattaaaaagacaagtcacgcataaaatattaatcatgttttatcatctaacaacaatgaaaataccaattataaaaaaatttcatat

SEQ ID NO: 108904 - DNA, 545 bp, Oryza sativa
tagtttcaggagtcatcatacccaattttttttgttaacaggtacgaattagattcgggctgctaaagagagtcaaagtggaccttctcctttcctccatgccttgataagcttgtgggtcgaatcattttgtaagagatcagtctcaactgcgctgcaacccaccatgggagaacgccttgcgtgcattgcaggccgaccacagcgcgcgtgcatagatgctttcagaattttttttatttatacatttttttattaaaatattaaaatcgccctcccaaagagcgtcaagggacctaaatgcaaaatttttatttgtgttcaaactctttccaccggttttaattgcttaaaaactaataatgcttatttgatactccaaataattttgaatggaaaagtgatgaactacaaatttatagatctcatcaagatctacaacttttatataaagtttatttccatccaatatcgtttgaaatgtagatctgagattttttaaaatatgttttatattttgtaacgaatatttggatatctaaaat

SEQ ID NO: 108905 - DNA, 1019 bp, Oryza sativa
aaaaatacggttagttcttacagcttatattagtcacatatcatgcattctgtatgcatgcttggtcttccatagaggggaaataaaacatggagcgatcgcatacattttagactctctattactgtacatacatgtgcaattccaggtctatgtgccataatgcacttaaaaacagatgtaagtacattgagaatgtgcattcactttagcctccccacccccaaatcagaactactatccatacaagtgcatatgacatgtccaaacatcaataaacaggctaacagaggtacctcagtactacactgggcacaaaaagccttttcagcaggtcaatgatcgtgaccttcagaccatgcatgtgaagaactgtgtcactaattcccacttcgcagcaaaatatattaaaaaagctaaattgatactcctagcatcatcacccgtcgctgtgctcaaataaaccccaaataaactaactcaacagatcaatggacatgacccagcgaccaaaaaaccatcaatgtcaaaaacattcccttggtctttaaagacagaattcccccatagccaaccggagtatcttctacaactgtcacggccaccgccaaatccatagtagaaaaaaaaaagggccacaagtgacaccgcccaaatctcactcctagtacaatattaaccgatctaggaaggcgagcaacatgcagcagctgtggccggcggccgtggtgattgcttggaacttggaagcgaggttagaagagtaaagttggggtttttttgctccccttacctcggagcagcgaaacgcgaaggggggcgatgcggccggcgtctgctccctactgcgagctgagcctgagctgctgagctcaccaccttccttcatacacgacgtcagtgacacgaggcctaggctcaccggagagaagcggaagagaacagctgcgctctgctcgctgtggtgtccggtggttaacgcgcaccgtaggactgggtagaccggcctcattaatgct

SEQ ID NO: 108906 - DNA, 899 bp, Oryza sativa
attttgaactaaatcagccagaattttcacttcttggctatttctcaggtgttttttttttccatgtaccactaaacgattcccatgtgtaacaacaaatggctccctaatacacgattgtttacctagccaatgaagtgtctttgttttaaatgtatggcattataaatttctacatggttttcgtctccattctaacttctgctgacagacacactacggccatcgagtgttgcaatctctccaaatggcggcctgccaagttgagcacagccgcgatttgtattcttgtataagtctcgaacactttgccacacattttttgtccaatgcaatatgcgttggatccatggtacattcgtacatgtgaataataaagtatgacgcaaccaccgggctgctggcctgaagaggcattttaggggcacttggcctgcactagttgttctttgagcagtgaaacatcaaactgttcctctgccgctcatctgtcatctcattgctcgttttctctgaactgttggacccgtcacacggtcaggccccaacgaggtcaaccaccaaggtcgccagcttccgtcccttggcgccgtgcctgaccacgtcaatgtcgcctccgaccgagcactcgttgtctgtgccctcctcaccgtcggccacgcaccactcgcccggcgtgacgccatcgagcggacgccgcagcacctcctcgtctatcctctgcagcagcgcgtcgtcgtcgtcgccgaacgccccggcgaaggccgccccgctgccgaccatcgcgtcgtaccgcgacgcctgctgcccatccgcgccctgcgacgtcggcgcgccgccgtcctgcgccaccgtgtgcccgaggttgtggttgacggtgctgttccggaactgggcgg

SEQ ID NO: 108907 - DNA, 3010 bp, Oryza sativa
ccgcgcgggggggacaaggttcttgggggatcggtcggtgccggggagggaagaggcgtgggggaatgaagcttcggtcgcggaagggagcggacggtatgggggcaggggcgcgacgagcgcgggccgcggggtgcgtggtgcgctggcggggcgggatgccgcctacgatctagcgcgaccaggaagaggacgactcggactctcaatgcgattggcgaccgcgtcacgagtatcacatgcagggagactgggacgcgtggcgtgggcgtgggcgtgggcgtgggcgtgggctcaactgctcaacaggaaggaacagcctcgactaatctgacacgtcttgttcctgagttttgacttcccttttgctactattcaaaagggacggattagtgaatcgactccagaaggcagcatgaattttactgagattttgtatgggtttctatacagatcagattagttttcgtagtgatcgacaaagtttttgttttttagaggtggccgttaaccaataaaaactaaggctgtgttcggttactggggttagaaacacatctctctacatgaaaaacatagcgattcattagcgcgtgattaattaagtattagctattattttttagaaataaattaatttgaattttttaagcaactttcgtatagtaacttttgaaaaaaggcaccgtttagcagtttgaaaagcgtgcgtgcagaaaacgagggagagggattgagaacttggagttccgaagacagcctaacctgagaactcatggaatcgtttgatgcaaacctcctaaacacactagtagcagactacaccgtgttacagtaaataaatcctttttatacagttgactactgaaacgaaatggaactgcctatatggtttttgaacaaaaacactccatacatcttaaaaatcttggactattgaattgctttgagatacatgcaacatatttaaatccatgttttctatgtcccttttttgtccactggcacaccgattttatgtaaacacaaagcctcaactgcctccccaccacgccacagtccggcctcgccggctggctagaaggtgtcaacggcaccgatgaatcccctcatcgtccgcccgtgcccaccatccaccactagcctttcgcctactgccatccctctaagccatgggaaacccccctttccccctcctcatcccacctgtactccaaccccaattatactgacacaccacaccatgttacaacttacaacgtatccatattttccgacgcaattagctaaaataaaattgtatcgtactgtcaaacaagtatcgaaagtttgtaactcaagtggcttaatgtagtcataaaagaaaaacaggtgaatattcatgcaaggatagtatgacatctccttgtgatttttttccaatgaaaagttgcataacaatagttggaacttgtttggatactatgaaatgtcatggaataaaacggccctacagcaaaagtttaagtgacttttgtttggtttgtatataatttttttaagatgatgggtataaatggcccttagtacgatggatgaaacttgaaaatagagagatggagtgaggagagagaatgggctgacatgtggagcccacagaggcaaaacaaacaattcaccactgccttccatgctggcatgcgagctggtgctccacgtcatccaaagtggcaaagaattatggacttgtctctctcctatggcaaatgtataaaggcaatcataaaaatggtatttggagagttatctttcataaaagtggcaaatagttaaatttcccaaatccacacatggatatataaatggatgtactttaaggcagccttataaccgaatattgaaaaagaataaagctaaaaaaccaagaaagaaagctactagtaaattaagcttcagatttttttttctttgatcatactctctgttactatccatcatcaacagatcaactttgaatgacgtaaaagtggtttgataaaactctggataacatggataaaacatcaaaatcctcctccacaacggaagaaataagaaagcaggaaggtgatactacagttaaaggaagagctcgatccgacttcgggtttggttgaaatttaagtgcgatggtttatttcaatttattacacattatgttgttgttttgtgaaatatatataaacatattccggagaagatagcaactagctcacgcaatgctctccgaatggcttacttaaatgaatcatatcccccatctccacacatccaagctcccacgtacaaaggagcaaagcagcggacactctagccacctgctcacatgcacggctagggagggcatgcacaaccacgcatcgtcgccgtcgcttcctcttttcagctcctccctccttctatgttgttgttacatgtgtttgaccattttgtcctataattccaactggccacatcgccactccctgcctcccttatatcaccaccaccaccaccactcttagctatcgatttggtggatttggtcaaacatccttgaggggagcacttgaacaactcacccttccgtcatccctcgatagagtttaatgagtttccgttgctctacattttcaatctatagtgcgatagtagagatttttgctcgtggatgctgggattgggtcgtgacccgtcacttacatgtggatcttaatgtatcaaagctagtaaccacatgcatcatacttgacacggtgtgtcaacttgatacctatggtgcgagacctcatacatataagtattggtttggtacccggttagtatcagatgacctctggtattggtatctataagtactaagtatgatatttaggttccatatcgatgtcatgaactatctcgttcctcaaatggtacgacgttctatatatctttcctacattggaaaataatacagaagatgtgactagggatcggtcacccgatccaaatctgcaaaaatcgggcgctg

SEQ ID NO: 108908 - DNA, 701 bp, Oryza sativa
cctttccgtttaaaattttcaactataaaattggaactttcaaattatattctaaaaccttcgatcaatcatttatttattgttttatttcaaaagtgattaagcataataagcggtatgcctggagttaattacgttaaaaaaacaaaacattgaaatgagcgtaggtcaattaattaggttgtgtaataaggtctctcggatttaaatatttttttatacgggtactcgtatttatgagtaactattttttttttggtagaccacgtaggctaacccgtggaactcacttgcatactaaaacaagccaggaacccgtcctcatccagcagtccaggtcctcggcattgtgggcttgtagccatccataagattgagatgatgaccggcagtcgcggtgtggagggagccctgcaaggctgcaagctggagcgcaatgcggcagccatgcatgaccttgagctcggaggcctcgttgcgggggtggtgaccgtgaagctggaggcctaccgtgctgatgatgggatctgccccctctcccttcgctgcaactagatccacccccatgagccccaagtttcgcatcatgcccgtcactgccgactgcatcgccctgagttccgcttctgtcgatcaacgttggtcccacaccttgagcctctgccaccaccaaaaggctgctaatggaggatatccatatg

SEQ ID NO: 108909 - DNA, 613 bp, Oryza sativa
acctatacgctagctactgtcaagttttacattgggagataatagtgtcttcataatagatgaaaaattaatatgattggtagagaagagagattatgtatttataatggcccactttaagaaatcatgggttgtggagtgtagtttctattgtgatgttttattgacatggcaccatgaacactgcttatagacactatgggttgggactgccctaataagccaagacaggcttattagggaataaaattaaatttgtaggtaaaacttttatatatgagttcgtagcaacttcaaaaccaataataaaaaagaaactacgatgaaaatatcttaaaatcaacttcagagttaagtttgaaaattcaaattttagcttttgctttgatttattagtgcaaccaatgcgctcgaatacggggcaggatgacaacgaatatgagtaggcagtcgccggcagcgaatgggaattgggtgtcctcgaagcctcgaggacaagtagggataaaaatggagtagatagtttccgtccgctccgaagaaaaagaaaacaaatacggataataatacatatatctttcgtattcgtgttcatcggatacctttcggatcg

SEQ ID NO: 108910 - DNA, 882 bp, Oryza sativa
aggtgttcaccagggccaatagcaacaaccagcggctgctccacgtcggcgacattgatagaacaagcaattaaggaaatgacactctgatttgcatctacatactctccttccatttaacgcatgaagccctaattttttttgcaaatcaaattagcgtgcaatctccaatattacataaactcaattgatgggctgcacatatcctacatttgcacattgtgctccatgtggctgcccgcacaggatagggtggagtgcgccggtgatggaggttgattgctatttttcttttgctcgtcatctctattgacatgaaccagaatgtttttgcatttttttttcgtgcttgttagatgatggatggctgctactgtgcaacgttgagctcatctctataccacaccgctacatccttccatgattccattgtcgactactgatcgccacccggttgccctctccactacccgtcataagacacaaaccatcatcttcatccttatagcaagatccagcaaagccaccagatagatttttggctgaatcatttttttttctagtttgattcacctatgagtaattttattgcttgtgtgtgattaagcctgtaatattttcattcatacgactattttgtgatacatatcaacaatactcttagtatcagtttcactcttatactgtatgttgaacacatcaatgaacatattactacacggtggctacgagatcatggctatatcgagaggaaggtggtaattgttttactcgcagaccacgaaatctcagtttttactcttatactatgtattgaatacatcagtaaacatattactacacggtggctacgagatcatgggctataacaacaggaaggta

SEQ ID NO: 108911 - DNA, 706 bp, Oryza sativa
agtagacctaaatggtgcacatgatttaagctgcgtaatttgttgccaagtcgatttactaccctataaactcaaaattttttgctatatgtttaaaaatacccgctgcaaatattttgtatttatgtttaaacttttcttttagttttttaagatagagggagtatatcagtaaatattagtatgcattcttatagtgtagatgctctaagttatacatcttttataaaaacagtattaattaataaactttagtagagaaccgtaaaaaaaaaatagtagtgcactaaatctatctaatgttactcccaccaaacaaaaacagttactcgaagaaaagattctctagcaaacgcacacaattatcagtggaatcttagtcagtacaggcaagtgtgcctgcccaattcggtgcatcaattgatgcccataatacagaggtatggcgactgtttcctgagctcaaattaagtcttcctggtcccacgaccataatatccttaactgtcctgcaacaagataacactaaacagcagtactgtttttcttctcagcatgcaactgcgatttgcaggtttgctgctagcgaacacttgcagttagcccctcctggaaacgatgttttgcagttggatccttaaaaactataggacatgtacggcgggtgtgtccacccgtaaaatactaaaatctatccaccccctgg

SEQ ID NO: 108912 - DNA, 720 bp, Oryza sativa
cttaaactgatcacatgttagtggcaatggtatcaggagggtttggttaactaccacacagtttgttgagccttatcacaaatttttggcagattttgcttcatcgatacagttctggcacgccaaaatctttaattcctcatacaaacatgccatgcacctctattactttaattatcacactttagctataactaagtttcgtatggtgtgatattaaatacgagtagatcgaccaaatatgcatcgaagcattttatatttaggaattaacgcctttgtcttctatatcctaaaacactttaatttagtttgaaaactcaaaaacaaggatttatcatttattccctcagtttcatattataagccgttttgattttttttcctaatcaataatttttaagtttatagaaaaaatatagcaacatttttaacccaaaataaacatattatcaaaatatattaaatattaatttcaataaaactaatttggtgttgtagatgttaataactttttttataaacttgatagcctgactagaaaaaagagtcgaaacgacttataatataaaatggaaagagtaattataaagtttagcctacatacttggccttatttgtttcagcttaaaattattataatccagattattgagtcagattactataagatgcattataataagttgagatagaataagctatctttagattattagt

SEQ ID NO: 108913 - DNA, 693 bp, Oryza sativa
attgtggctagccagtttagtagtggtttagttcaattggcctcccttaatccgcacgcttaagatcggaagggcgccggaaagcatcacatcaccaagctagcttgatctgctcctgcctccaagaaactgcgagagctactactgcttgacatgcagcctaagcatagcttaatcttagcttaatgatgtcaccctcacccatggtggaatgcaggaccagctagtcattgttgtttctggaacaagtggatcattacctgtattaatcactatattttttctcctttaaagaaacgactaaagcatcctctctgttttttttctttttcttgcgttgtgtgcatttgtgtgtgctaagctcacatggacaagagagattgaatcgataaatgcagtgacagaccggaagatttagtaccggttcagacatgatcagacggcctcaagaacgagcgggaattaacacttgagagtcatctgtatgatcgtattcagatgatgttctgagttagtatcagatcagatggtttaacaacaaaaacaataacagagaagatgttcgtaagaacaatggcaaacaaaagaaactcctttctgaagttcactcaggttcagagcaaacagcagttaaagaagatcggagtttacagagctggaatgtccaagagattgtagtgtaagcactcattt

SEQ ID NO: 108914 - DNA, 527 bp, Oryza sativa
cattagatggctcatgaggcagctaaccatccttggaggtccttgtgctgctacttgtttgttctattgtgtaacttttatgcaatatgcttgctaattgcttggaattcactagtcatgttggacctagccaacaccctgtcgaccgtctagtgcacagcgccttcttgaacaatgcatgtataatcatcctctttggacccagattgtgtaaagagagaaagcaaaaaagaattcaggctaaacaagttcgatggagaaaacagaagcagtgaggccattttcgaaagttgctccctgaatcagtcaaatatgttattttaacaggataagtgtccagtatcaaattactacgaaatacaaacttaaagagtgtcttctagttaataagtgaaccatgttttttgatatcttgtggcaagaccacaattttagaatttcctttagccaattttgccttaccggaaaacatcaaaggattctaactatttcagaacgcatgaagtgcatatctgcatgttattttt

SEQ ID NO: 108915 - DNA, 500 bp, Oryza sativa
ggacttgagagctagctgtgagctgcacaaccctctttctatctctctccctctctcattttctccgtttgccttgttaccgacgaggtttctctagttctctctgactctctctcattctctagctgctgtctccaatggacgagctaggcccgacggaaggtggacatggaagccaagaagacttcactcatctttcccttgttgtgctcccacagtccctctacgtctcatcgcttcctctcctgttaattgctgtcgtgagccgacaatgtcaatgatgcagcagtgagttagcgacgttgcaggtgaccacttgagcactggcggagcggctggatggtggcggcgatgatagcacaacagtggggactggtcctctctctctctctctctttttttttttgattttactaaacttttccagattcttctttgccccaagattattttcagaccatttatcttatcctatggctatgatatatactttctcccta

SEQ ID NO: 108916 - DNA, 638 bp, Oryza sativa
aacataagcgaaaggatgaagccctagctcgactcgactcattaaaactacaagttcaagtcaatatgagttacgagtttcgaggtttgatccgcccctaaatatatgtgatagtacaatctcggttgagcaatgtggatggttggatctcaatcaaatgacatagttcagccttgatcagttgattgtcaggaaaggccagcctctctacgattttttttaaaataatactatattaatggaaaatattactgtggtgcttccatatgatagagattttagtcatcaacctctatgtttacaatttttcattaaaatattattatattatttcaaaaataatcctcttaatttctccacattccacagcgatctgtctctcttttctctgcgcttatctttgtgccttgaccttgacaaccaccattgccaagcagcagaacaaatctcatactatcatattctcccatgtgtcaacacttcagtagtattaggcccaggggaccttttttaggcccaggggaccttttactatccggagatggggtagccctcccaccgctaacccttttactgtacctggggataaacctgccgaacctgacgagaaaagatggccacaacttttacccgaaaat

SEQ ID NO: 108917 - DNA, 642 bp, Oryza sativa
ttttattggttaaataaactatttacaccaactttttcatccagacctgtcttgtttcaaggaccgaaaaatcaaacaaaaaaatgaataagttactcttaatttgcaccgggtaaaaacacactgtttcactttacactaggtttagaacatactttcgttttacaccaggttgttttaaaataagtttcacctagcagtaggatacatcaccaaaaacctatagaaatttcatcaaattttataaaatacgaatggaactttgtaaatcatggtctaaattcaaaacatttcataagtttcacctgtagtttataacattttcctttaactatatgactcaatctagtaaatgtcaaacttattttgatataacatggtagaaagtgaaaatttacagtaaagccagtttgaaacaagatacattctacccagtacaaacttcaatttacttaataaaaaattcagctacacaaaaatgtcggtttgatttcactataacgttagtgtttgactatataattcagtgcgccattgtaagtaacaacgtcttatagtccgatacatttgggtggctcagctcgctatccagtttttagctacagcaaaccctgagggactcttaaactacacttctgactt

SEQ ID NO: 108918 - DNA, 1000 bp, Oryza sativa
aagatttgaagtagtgtgaatcagcacccacaaggttcattccctttatcaacttcattcaacaacttccaaaaataagttgaaaacaaatgcttttttaaaagtgcattgcaaccctacataaaatgcacgacaaacatgaacattttttacatggtccctccgtcccctaaataaaggattttgatattttatttgcattatttgaccattcatcttatttaaaatttttttggaattattatttattttttgtgacttactttattatccaaagtactttaagcacaactattcgttttttatatctgcaaaaaaaatttgaataagacgagtggtcaaacagtgcaaacaaaatattaaaatcccttatattatgaggcggatggagtacttaatagtatagccaactatcagctctaaatcatcagccaatctaatagcctatttatacaatagttaactacaaatatactccctctgtacttgtaaaggaagtcgtttatgacaatatttaagtcaaaccttgggaatataaatcatgaataactctcaagttattgagtttgaaaattaaaaattatatgaatagatttgtcttgaaaaatactttcataaaagtatacatatatcaattttcaataaatatttttatagaaacaagaagtcaaagttttttttagactgtgtcgctgtccaaaacgactttttttaggcatccacaatgtagtccaaaagtggtccataagtaatacaatatttcattcaactacctagcaacattgtggaactagttaataggaaagaaataacaaatgctacctgtaagcatatgtgctgcccatagagaatataatatattatttgtctctacttcttctctcctgctaatactatttgctatctatatacattgtgaagattacaatagttaaagtccatatatgtgagtcccatctatatgtactacttttactatatatattggggttgcccttac

SEQ ID NO: 108919 - DNA, 743 bp, Oryza sativa
ctatgtcaactttatgatggattaatctatctaggcagtacaccctcaggataagaagtagaactcctgagcagcatcatctaccggggtaatccaaaataaataagaaaaaacagtgtccgcgtagcacaccggtagttaccaatgtagaacacaaaaaaaatcaccctaaagctgaccaagagcaaagtacagtgacaaatctaggctacttcagatgctaatgatcagcatgtcctatgaccgacaagatgctaaactttcttcaggactactttcaaccacaaggttgctgttaagttagagacttaaagtaatgagtaatcacttctactatgtactatctctagtaattacttccctgtactatcttgcctacggaagatccaactcaatcattcagaagattttgattgctccaagacttcaagtactaaacagcggaaaaaaaaatcccacgtttgcatagtacatcaaacttaggagaactcccgcttttcaggggggaaatagcaactgaaatccgccaagaattcaaccaggataacctatttatcatcacacaaaggcaatcttgctaaagaaacttcaaatattggcactaattcctctgtaccctaagcatcgcttcaacgcagaactaaatcagaaatgtcaattaagaaccgtacagtccatccaaagtcagaagctctgtctcatttcattggcagagaagaaagtacacagcatgtacccaagaa

SEQ ID NO: 108920 - DNA, 574 bp, Oryza sativa
acaacattttatataaccggcccgataaccgtgtgccactcagatcacattgaacctgctacaccacatatgagggacaaattgactttaccaactttctctatttgaaagtggtaaattgtaagttaaaagtttcaaaatatgagttacaagatgttatataaccggctcgataaccaaatgccactccaagttcacatagaacctgctctactacagggagccacatctttaagttctgggcctacacaacccaaaagactaatctgatgattgaggaccgaccacaccttgtaagacgatctcccccatcatcaattaccaatgtgggactaaacccaacaatctccccattacataaattaccaccatcatctattgcccatgtgggactaaacacaacaatctatctattacatcaacctatgtgacccctaagacttgttacctggtctgtccaccatgtgacccgggttccaccttttaagtcacatcatgaacctatgtgacccctgagacttgtatactggcctctctacatgtgaaccatggaaattgttccaggaaccaaacc

SEQ ID NO: 108921 - DNA, 3600 bp, Oryza sativa
aattgggatatctagatatgactgtgttcagatgcttcttgcaaatagtgatgacggacaggaggtgcggtggagcttagcaataaaggggatcccacaaccacatatttcacgagtcacataaaggggagtgtgccggcagcggcattagcaggcggatgggggaggcgacttcagcgaatgcgacgcggcccctcccaaatccggcggagaggggagctcgggcgccgacagtggtgaaggcggcgcctcccctccccttcctctctctccctcctagatccagcagaggccgggggagctcgggcgctggcagcggcgcctctcctcccattcccctccccccccctcctagatctggcgaaggggggagctcgagcaccggcagcgacggaggcggcccctccctctctcctagatacgtgactcttcaaccacatgtacgagcaattaactttgtttgtttcttattggtacgaaatggttgtaacctatcacatcatgataaattcatcccaaattaaaaatcacttcctaaaataaatgatagaaataattaaaagtataaaagaaatctcaaacacaaaaatacacgcaagaaaaaaaaatcgaatgtcgcttggagtatctctcttaaattcttcatactctaaaatttctcaacaatttttacttaaatttttgtagcacaataactgattttagggcaacaacaactaatttcagagtttattaaaataaaaaacataaaaataatcctctccctctgtttggtccgaatctggctcgacgtccgtttccctccaattcggcccacgagtgatctcctctttcctctacccctttcccccatctccctctccttcctaggtctcctctctcccttgggccacaaccttctcagcccacctagtcctccctccttcacccctcgccgctcatgcgcccctctcccttgcttggtctaggtgaaggccgaggcctccctcctcctcacacggccatgccccggctagcccaccaagcctgtcaatcctcttctgcttgaggaaccctagcgctgccaccgattcgatctgccttcccgcttgtttccccttccaattgaatgcaaaaattgacatctcccttaggccttgttcggttagcccgggaatggctggggttgggctgcggatcacctcaatgcggactgaatcacagcccatagaaaaaaatgtgtattcgattaggaataagttcactttaggtccctaaatctatcgtcgagtttgaaattcgtccatgaactgcaaaataccagatatggcgcgtccctcaacatctaaaaccagtgcaagcgccaccgtggcgttgacaaaatcagaaaaaaatcatgggacatattagtgagtattcggtaaaaagttaagttaaaagaaaaatgcagtgggaccatgtcgtcgcccctctctctttcccctcttctttccgcattgtcatcctcggaaataactcctaaaccgatcgacgaacctggcgatgcgatgaggaggaggcggggatgtcgggcatcacttggaggaaccgggcttgtgaaaggatcacgttggccttgtcacccacggcggcggagacgcggagtggagcgagaatgaggagctcgaaggacgggagtggaggaggcgagggtcggccagcgacgacgacgcgcggtgcaggccgcggccttgggtgagggaggtgatatatatatatatatatgcgaccgcccaacgaggtaggcgcaggccggcggccgccagctggggcgggaaggaagcgaggtcacctaattccgtggcagactagctcgatcgatcggccatgcggagggcgtcattggcgaattcaaggtggggccgaggcggcagggtgaatgcgagtatgtggaagaaaaccacgcgacgcgaccggatcaggcgccgtcgccaggggtgctagctattgcggcagccgccggtaagtaggagtacgtacttcctccccctctcttctcccatgtcctagtgttagtgcttcttgacgccatttaacccacacctggcttgcctgtggcggcggccggcatcgaacccctgacagtgaatatatacagtacagcgagcggaagtgacatgcatggaggtacgtacgtagtggctgcaaaatggattagaggatagggaagcttgacctgcagttcttggtgcagttctttttggtttttcttgtgtgtgttcttggatgcaactttggggtctctgctggttggtgtgattgggtctctgagtactttttcgtatgttccattgggaattcttttaaaaaataatacgattttaatggaaaattgtaaaaatatgggtcgattaggcgaaaacgcatgttcagcactctatcgaacaaccctgattcgacgggggtgtggtagttcgacagggtagttggtccaaaaaaaaataaataaaatagtactgctacaggaatcggcaggaacatgtcgaactaacaaagttcgatagggtcgcgtgaacagtaccgcttcaggacatatcgaactttcaagctacagtgtttttccgattttttgaagttttttttatcacctatcgaactgccgcagtaccctgtcgaaccccggttgtttgacagggtgctattcttacgatttcgtctaaccgacttatatttttgtgattttccattaaaatcgtattattttcaaaaaaaattcattcattggggcagtaggaggagagggaggcaggagtagtgtttggctagccatctcctgcatgggggtggtggttacataagaagagtagggacagagtgcattgtatcagtagctactttgtgtatcagagattcagagaagctgcactagctagcttatctgaatcttctaatgcacagtaatattagtctatcacaagtactaccagtgtactaacaaagagcagcaacgaataaaatcctagtactctctcttcagttccaactgattcccatttctacccagaatatacttggctccatgccttcctaggactgcaaccaaaatgtaaaaactacaactaaaatctaatttccacatacttgtttagcatagtttgatgcatgcttcttcagagcagggaaccatcaaacagagttgcctgattaatgtaaggccatatgaatggactaattcagctgaatggtattatatgtacctaggcatatgattttccaagtgccaatagagtagcttctgcttctgatttattttttttatattaggtgagttaaagaggtgactggaggtttactttttagatttccttactttaattttactcatacaggcctgcactagctcatcttgaagctcttttgagtgagtaataatgttgggcctaagctatagtttctttctcatgtcattgttttcgtgcaactgttttttgttcatcactagattatttgaatgcctctgattgtcatcaggcgacaaaggtaggccctgaatgatcactcaacatgttgggagatagtcaatactagtaaattgtggcataacgaaaggcaatttgttagcctgcacaagttctcaaagta

SEQ ID NO: 108922 - DNA, 592 bp, Oryza sativa
ttttccctctctcacccaaataactgccatgtggtccagggctgcttggtgggaccttattgtcagcctcacaactttttcacacgggccacgggctgaacactcacccaacgcgcgtgagcatggacgccggcaacgtgcgctcctcctcctttcctatgccggcgacaccatatattacccgaccaccggaccatcactctctctctctctcgcccttgtctactctcaacaccctctctaacaccaccaagaacgcctcatttggtgcagccaatctctgggaacgcgaccgcatcaacttgggacgccgccgcgctttggacaccgccgcatcaccattgttcgttgccgggctaccacggttcgcgacaagctgaaccacttcgccacgagcttcatcaacctccattgatcactactacgaaaaccatttttcgtggcggccattttaggttattgctggcggaaataagagccgcacaaagcaaaggccagtgaagatcaagatcttcgctggcggttatcgaccgttagcgacaatgaattataactggcggtcgtcattagccaaccgccagcaaagatccat

SEQ ID NO: 108923 - DNA, 604 bp, Oryza sativa
cgaaggcgcgcagcacacaagcggagaggaaggcgagccgtcgcggacgaacagggagcagtcgcgcgaagcgcttcccaaaaaccttattgccgccttctctcggtgcaggacgtcgaagacagaggttccagagacctgctctcccgatcaccggtgcacgccggcgagcgggatagagtagtctacgagcgacggagcagcacagagtaggaggcaaatcctagattgatttcgcgtgtgttgcatgaaggcggcggctcggtttatatagagataggtcgctttgatcagggcgcccgcacgatctccactccgcgtaaccgaaccagataagtcgcaaacttatccggacttcacgccgttttgacgcaccagatttttcggaatgtttccaaaataaaacaaatccgaatttccggcagcaaaacaaaactgcaaaaggaggctgcatctgcgcaagggtgaggagccaattttgcggaccattcgacgtgtacgtcgtgcacgcgcgccgcttgccctgccctgccctgccaggcgtggcgagcgagcacacacgtgtgttccccctcttctctccaccacacatgcttcaagtggc

SEQ ID NO: 108924 - DNA, 1026 bp, Oryza sativa
cctgcagcccaatacatttaacggttggctttctcaagcaccaatattttgagcaaaagtctaagaaaagcattccgtagcgacaagagccgcagaaagtgaaaaactaccgtagtgaattaggagcgcaacaaattaaggggtaaactgacgacaaattaagggatctaaggtgaacttattccataccgtaggaggaacccgcggaagagatccagcccagtagagcccaacctggtacttagcagccctgaccatcatcagaagcatggggctgcaagttttccctgttataattaggagcgcaagctgcgcaacaaatgcgactgtaaattctgtgattaagtattaactagaaaatcagcatgtttgttggcgcaccgaccagttttacttttatataagtttaaggatcactgcagcatatgagttttcgtaaaattcgttaaaaaaatcattcaaacatctctatggattttaattcttcgtggaactaatcaaattacagtggggattgtctacagtgttacagctgtagtagcagccgctgacatgtgaaaccggcactgctactgcaaatacagtactgcagagcatccatatccatcaaattaggatagtaatatatggctgaggatggcctgtttaatttttacctagctgtgttcggtactcttcccaactctcctctctcgttttccgcgcgcacgtttttcaaactactaaacggtgtgtttttttgcaaaaagtttctatacgaaagttgcttaaaaaatcatattgatccatttttttaaaaaaattagctaatacttaattaatcacgcgctaatagaccgctccgtttccgtgcatgggagatgggttcccaacaccaacctccgaacacagctagagtacatttctctttacgcaatcttttattagatatttctctttaaccattctttagccaatatttttgttttcaaccagataattttacctttgttacactttggatcaccgtgactattcttaaccgta

SEQ ID NO: 108925 - DNA, 1339 bp, Oryza sativa
attcctgcagcccatctcaacttacactatagatggtaagtcatccagccgcaagtttccagcagtgatagataggggtggaaacgagcctagccaagcctagctcggctcggcttgcagtggctcgcaacaaactaggcttggcttggctcggcttggttagggaaacaagcttaaaacttgagctcggctcggctcgtttcctggctcgagccagctcgagctggcttgtaagacttcctgttaaaacacatcttcatatatattttgtaattattaaaaaaagcaagaacaaattattaacatgtaaaattaaaataaatttatggtaaatttgaagttgacaaataataacgccatataaaatgaaataatcgatataaacacaaaatggcctaggctcgcgagccaaaataagcggctcgcgagctagctcggtttggctcattttagcaacgagctgaaaaggaggcttgggcttggctcgtttggcttacaagccgagccaagccaaccaagctcgacccaagcccgagctgagctcacgagcctgagctttttttccacgactagtgatagatatttggtttggtatgtactctaacattgtaagcgactagtaatttcgttgagctctaatggtcttagcagctaattactctctacactaatatgaccagagcaggattatacttttttaatttatttctgcttttggcttaagatggaaaaactaccccctataatccgctggatcagattatctcgcgacaacgtcaattcagtaaccacaccctcctttctttctgaacacacttgctgtcgataaccatccaagacccaactttatttagcccatctcaatcagcaacacaaatgaccctgacccacgatccactcacaagccattgctcgagatttgagcttgaactcttcttggcgggacccaaacagtgcacgaatttcagacgcattgcataatcaaacccccaaaaaggaaaaagccgtcgcctttcaccaagttcgaattatttttcgcctttggagacggcacaaaaggcaagaaaacggaggaggaaaactaggccacgcattgacaggatcttctcccttgtgttcttgctgcttttctgctccatgtcctgctcttggagatggccatggctctggctctgagctgtggcaggaggcagagagggaagaaaggcggcggcggcggcggcgactgcggcggccgccatttccatgtccactaccatcttcctcgccgggtctgcgcctcctcgtttgttcccaatttgctgcctcgttttttctcgctgctgtcagcttgcgtgct

SEQ ID NO: 108926 - DNA, 1902 bp, Oryza sativa
catgacacattttctgttgtatgcagatgttggcaggtcatgggtggaactttgggacaacagaaaactttagatgctcatcctaatcctgtgttgacaatgaagaagtatttgacagtttggattgaggtattgaattgtttatagtgaggctgtttgttttgttggatgtatatatttttttgttagattgcctgattagtttttgacatgttgtggttcattggctttttctttaaaagctgagtgctattctttctcaagaaagaaagcttcaacttactgtaattgattttgaaagggaaatggaactggaaatgcttgttgacttgttgtatagtgtatactatatgctttgagaaatatgtcttctacagttgtctggatgtacagaaatctgcctgctacattaaagcctacgtatttttaacaagaaaaaataaggcattttctatcccaaactaatttactggatcacttaacccccctgaattatttaaaaaacaagaagaatttaaaaaaatgttgagatgtaagttacaatgcatataccattctacccaaaaaaaagagagagaaatagcgtcagggagtaaagtaaaatttttttagtagttgggagtgtaaaattagcaaaaacaactaatttaggggttgatgtgtctgaaatagttcctggcgagtaaaatgaactttgtttttctttttaacaagaactaggaaacctgccagatcaatattaatcgacggctgtttcgctgtaagaaaatgattattctatcttagtctaacaacataggcaacttgttctggagatgaataatttaataaccacagtaaaacttcacttatcgtttattggcatgtggtaaagtcaaaagaataaaatgagaaaaactgtagaatgcaagtatgcaacaattaatagtagcattgcatcgtatgtgtcagtagaaatattccccgaagtgattaatcctaaccctatatctgtaaagcaaattaacaacaacaatcatatctctactacttaaaataaaaaataagaggtgcttccatcatccataaaaaaaactggacgataaaaaccaaatataccaaatatgtccgtaaaaaaaaccgcgtggaaaaaaaaaggaaaaaaaccaaacctgtccaataaaaaagggcgaaaaaacgaaaaaccgggcgaaaaaaccaaatatatccgatctagaaaaaatatctgtaaaacaaattaacaacaacaattatatccctactacttaaaaaataagaggtgcttccatcgtccgtcaaaaaaactggaccgaaaaaccaaatatgtccgtaaaaaaaaccaggcggaaaaaaaaggaaaaaaaaccaaacctgtccgattaaaagggcgaaaaaacgaaaaaccgggcgaaaaaaccaaatctatcggatccagaaaaaaccgggtgaaaaaaaaacctaaacctatccgatcccaaaaaaaaaaggggtgaaagaaaagggaaaaaaaaaccggatctgtccatcaagaaaaacgaatccgactctgggtaaaaagaaggacggaaaaaaattaaaaaaaaaaagaatcaatccgattctctatctctaaacgaaaaaaatccaactctatatccgattcctccttaaaaacgaaaaataaaaggcacctctcctctaggaggattggagatctgtttgcaaaaacataacctacatgttaagagcataatatttttatatgttttaatttttgggtatgtacttttgcatttgagtccctgtaatttttatatttatatttaagtccctataatcttgcaataaggtatttgaggtcgttttttaaaaaaaataataaaagggagataacaaaggcagaaaggtgcatcaaaagaaaaa

SEQ ID NO: 108927 - DNA, 2280 bp, Oryza sativa
caaaggtggcttcaaaaagtatgtaccgctgctggatgatgtcgtggtcatgaagggtgtcggccacttcatcagtgaagaaaagccaaaggaagttagtgagcatgtaatcagcttcataagaaagttatcggctgaaatgtgattattcatcatgaaattcagagtgagataaaaataattgcaatgtattcttgcgtgcgaaccgtaaagtatgttagcttgcatttggaggatgtggggcgcgtaatgctcatgaattggtgcaattagtaaagtgttcgatttgtacacatcatgaagtctataattgtcatatgcaatattaattggttatgttaattgttcgaatgaatggtaatggtactatgattttttttttaaaaaaaactaacttgtggatacatggtcagaagggtttttttttaaaaaaaacggagggaatagtgatatagcgatatatttttatatgtttctaataaagtaggatcccgttgcctgctcttcaagcttcacttattaaagaagacataccttaccacaaagctcttttaggggtgaggtcctcactagcatatgacgtgagatgaatttaagacttttgtgcccaatcagatataaaccatcatttttcaaaaaaaaaaatataaaccatcatgattcggtccccacaagctaatatcacctcgaacaaatgggttttcacacataagggcagccacaaagtgaacataaaggtgggtcttaagcctctaaagtgaaccttatacattgtaagagtagtttttatagatgacatttgtttgagctagccatatgtataaagaccacccacaaggaataaaaaaatatattgctctttcctctctcatggtagtgatactctctctccctctctcaatgactaatcttgggtttgtggggtccaccttaatatccactcttacggtcttaccatatatattgtgcacatgataatatattttagtgggatccaccataatatcaatgtagtccatatacattgagcatgccctaataagttttaggtcatgttttaaatataagttttgtgaagattgttgttttaatcaccacaaaactcgttggattgtgcaaggctattctttgttccctggcatcttgtcaaccacacctcaaatatcatttagtatctttctagtatgtactcctccgggcacaaataagtggcattttaggtaacccattttaggtcaacgatgcatttgtttgattacttctattactaattactaatagagtaaattttataaagctacgggtattttaactaaactatcagaaaactacaaatttaagatggtatattatacaactatagatttaaagctaaacatgggtgaatagctaatacggtccctgaagtttcacttcgggctcagtttagttatcgatgtttcaaattgtccaaacaagttctccaaattaatcatttgggcaaatatagtcctttgacccataaaaaatgccacttgagtatgccaaatcattcttgcacgcagcggtatgaataaaatgacaattctacccttatatgccatatagaaaagaaagaaaagacaaacaaaaaaataacaagcccatcattattgcggatgggtggccgacaaaggaatttacacgatcacgattagtgcttggctacaacaatcgtaagttacaattctaaaacgatactacacgtgtgaaacatttatctttttttctttctttgctatatggtatataaggtggaatggtcatttcattcaaactgctgcatgcgaggatgacttggcatgctcacatggcattttttgggtccaagaactatattaacccaaatgattaatttgaaggacttgtttggacgatttgaaatctcaaggactaaactgagcctgaagcgaaactttggggaccatattagctattcacccgctaaacatcacaaaactagagatttagtactgaaggtagcacaaaactacatattatagagtttaaatccctaccactactagtattattttggagctataataaacattatagttttgcaattgaattggtgctaaacttgtattttgggataattttgttactaaatctgtagttttgccatacttggctctaaatttatagttttgtgataactttattgttaaatctattattttgtgatacaataccttacatatatagttttacaatagtttgatcaaagaatatatttgttttgtgaaatttactcttact

SEQ ID NO: 108928 - DNA, 765 bp, Oryza sativa
tcctgcagcccgccgtatgtagataatttctttgacatatgacaaattaaaatcatatggataaaagacttgatagtggttcaaggtatcacaaatgtcaaattattcggttcaaattaagtgaaaattagtttaaaggtgatgcaaagcgaacattgataataaagagtagcctaagtgaaattcactcttacaaattatacttgattttaatttcaacaacttatttttcgttatttttgttaatacattttttttattttcaagcaatatataggacataatagacacaggtaaactacatgcctcaatttttgatgaaacctattacattttgtatttggatgaagaccatcctagcaaaatccattgtatttgaaaaggctaaaaatcataatattccttgtttttctctctctttttacttctttaactttcatctcctcttctcttttgtatatacatttttaatctttacaaatttttttaagcttctttcatctgtaaaatgtaagtaacttatctatatcttatcacttctatattttagagtttgtctacattattttttccacccctcgtaaggtgggcagggaccaagcccgagggaagcttcacgcctgtgcttgccccgtttcggccgagcaacgtgccgtcgtgccctcgtgaaagcgccgtactcttatcctagcaaataaaaggcacactgttttttttacaaaaatttgtgtgtacataactatcttttgataaaatggacatatg

SEQ ID NO: 108929 - DNA, 1762 bp, Oryza sativa
tcctgcagcccagtattgaatcgcccacccgttacagaggtaatctcgcgaagttgaattctgaaccgttgcaaaaggatcgagagagagaaggatttgcttccgttaccgtagtaacgatgcgattaatgagtattaaatcgcccgcccgttacagaggtaatctcgcggagttgaattatgaaccattgcaaaaggatcaagagagagagagagagagagagagagagagcagagctgcagacgcagcgcgcgcctcgcccatggccttcgcccggcccgacgcgcgtgcgcgcatgtggctttccgacccccacctcaaccggtcaacagggagcctccaataactccctttttaagttgaggtactccacttttaatccccaaggtggtattattatttttaacatttatttatgggcccttgagattttaatagaaataaattgggcctagcccatttattctaacaatgtcacagtgttataatatatggataagtaatttaactataggttttgccgaaagtcatcggtttcgcctgacaccttccattacactgtagatccgcccctggttgcagtgcgcacgcgttcgttcgtctccggtgtcacgcccatcaccctgaatctcatcgtttctttgcatagtcggaaacggagaaaatgaaaccaagaagttatatccgttatccatagaactttcccaaatcagagttttatagctttgatacaactaaatcggatgcataaacaccgcaaggcaaatactagaaccgaaggtcgaaaacatatccaaaaattccctaaaagacccaatatttggtctacttgcaaaaacaagaaccagaggtagaaaaacaaatccaaaaaatccctaaaaaacttaatctttggtctacctccatccgcctgagagataccactttcgtcgctcatcactactagccaccaaatctggctcccttcatctgctgccatcaccactagttgtagagaaacctgtggaggcatggggaggggatgcggcggagagccggtggacgggaggtggaagggatgcgatggagagctggtggggtgagtgtaggggtggccggtgaggaaatgatgtcaggacggagtaggaggaggaggaggaggaggtggtggaaagagcggggcagaagaggaggcgacggcggtcggcgcgctacgcaaaggaggaggcactgattgtggagtgggggagaggtggtgggtgagatgcaggaacattcctgagactacaagtcggtctgttcgatggtggtgaagatccgcccgtcaattgcgagcagtgcgcctcgacggagactgtggatggtgaggcggagtctgagtgaggtcgccaaactcctccgctggtagctccaccgccgcatcggggtcggagtcaccctgatattgaccccctaccatgatcttcctgcagctggaagaagaacaagtgtgagaacacaaactcagagacgtgcagctaacctggcatgccaacgatcagagcaagaagctcctctaatgggaaggcaaggtaccctcccttcagagttcagccagggtgcaagttccgagctcatggccggggcacgtgaaagagtaagcggaaacaagtggtttatataggttgggggcactaagaagtgtaataccatactcctgtgttcttgcaatatgtgatgatggtcgagtttacgacagatgttggtgtgatgtgctaagtgggagaggataaaccctgttct

SEQ ID NO: 108930 - DNA, 670 bp, Oryza sativa
ttttgttgtatgacttgccaagtatttcatatactcatcttgctataatcaccattataagaggatccaatccatggaggtgaaagtttgaaggtcttaggttgctcccggtcatgttgcatgtgggattggtgctgaagctacgctaatttaattttttgctgcagttttcttttcttacgaggagtaaaaaaactctttgtaagtattatacattgtattcttccaattctgtattattggttgttgatttgtacaataccttttggataatacctaatgatgatgaaatgcataaattgttcgaaaattacttgtgaatttctctagccgtgatagctaggcccaaaatgttgcatactcaaccaattgttggcacgctatatatttgaatgcactgaataggttgaaaatcgtgtatgtatcgaatgtagactactttaaacaacaaatatagatggagggagtagcatatacaaagtgtccaaccccatatcatcttttgtgaattttgggacatggtatagagaggagggagagagaaacattgactccttgccaaacaatggcttccggtgtgtttgagaggaggagaaatgagaagattaagatgatatgtaaaagtagatgagccactaattcaaatttgaaaagtggatttatatgattt

SEQ ID NO: 108931 - DNA, 613 bp, Oryza sativa
atgaacctcctggactcagtcggcgtctcgctgatttgatagttttggcaagttcagccgaggggccctcgtgacatacctccaacaatgacaaagctgtcacccgccctttaccactggatttggttcttcggcgccaagcccattgcttgcccttcaccgccgcatggtccatcgtgaccgagcatcacttgcccttcaccgtcttggcatagtagccactttgtatcttacatcttcaatatcttcactttgtcatcattggtatctttaggtgtaatgatatcacttgagcatcaacacctttacaatccttgggatctaattatctcattcaactcaatgaaattattagtcctaatgatccggttgttaacctccacatgttgaccaaccgatcgtgtatattaaatgatatgaacaagtgatgagtattaattaataccaagtgtcatatacttaaatgtaaagatcccaattaacgaaagtgaataacatggatcaagtacattcataactaaggtataggatttgctcccctaaatatatgcatacggaatatttgtgtgaagcaagagtttgcataaatggagatgaaacattggaagcttat

SEQ ID NO: 108932 - DNA, 1212 bp, Oryza sativa
  unsure (1)..(1212): unsure at all n locations
gcttaaagaatatttggtgatgaatcaagtcacaataaaataaatgataattacataattgtttcgaataagacgaatagtctaatgttagacaaaaagttaacggcgtcatacattaaaatatggaggtagtaataaataaagagctgtctgattttannnnnnnnnnnnnnnnnnnnnnnnnnnattttattatcgccaggtgtttatcaaaatcgaagtttgattaagtttacagaaatatatagtaatattttcaacagaaaacaaatatattattaaaatatatttaatgttatatttaataaaaccaatttagtgttttagatattgataattttttacataaatttgtggtcgaactttaaaaaatattctatctttgatcactatttttttcataaaaaataaagttacacgtgcactggctagtagctatatatataggtgggtgcatccattggaatatgggtaaccatgctttcctgccgtgttttcttcctttctaccctgtgacgttcatcagcaacaagtacatgcccggatcgacttaatttgatccacttgattattttgattagtaatcgatttcccactgaccaattcttacacgtatgtctaactaggtcagacatcatagcatgtcgatattaatttatcaaattgcggagaaatattaataactttgtctcttataggaatatgtccccagcttgttgcttaactaaatgtcaatccaaataataatcatatattttgttgaaaaataattaacaatatagatcaatatctagtatcacttcacaaactttcaaacaaacaaattgaactctaaatagtacgtacgtactagtagttatttttcaaggtatatggtaatgtcaagaagtaaattagtaatgagcactctaatattttacccctcggccatatagctaaagctatttttttcttagctacaaaattaggttttcccttactttgcatacactatgagcttccttgatgcttttattgggatcgatttacatggacaccctatagtttttttttcaccacttttctttttttttcaccatatagtttttttaagcttatatacctaaaggttatacttatagggtttacacatcttttataggtcaaaagtttatataccgattcaaattggaatttaaatttaaatacatctaaagatgaacttgaatctga

SEQ ID NO: 108933 - DNA, 3050 bp, Oryza sativa
cctgcggccctatgatttactattacgcatcaactcttcataccaattttccatacccttcagtttatgcgctagattctccagtgttggttcgtcggaacttgtacctgacatcgttagcaagcaaaagaaactcacaagaaagtgtcagttcctaacaatctatatatatgtggagcttttgaaggcactcaacactcaagcatataccaaattcttataatattctcaaagaatgcaaaacaggtcaatcaccgtggctggttcgtggcacaatgacacgcttgatgagtggagcaattgcaaggccggacctgtaaaggttaggagtatgtggatcttggtaggcttaactatatcacaaggaatagcaaaaatcaaacagatttgcgaaattgaataatagtccaaagtactagtcaaaattgctggcgtagcctagactcaatcctagcttaagcaagcaaatgatcacactcggacaatccacaactcgctatagtaagcaactctctccaagattccaacaaaaaaaattccactctttctttttctgattttttttctctttttttctgttttttctttggtgcggctctttttttctttttttttctttttttttttgcaccttctgccttttctttatttcttttttttttggcaagcggtatctaccaaatggaatagctggtaaataagattacaaaggactcaagcctagaagaaaaaaaaatcaaatgaccaaagaccaaccaaccaggtgcttgtgcgtgtgaatgtgtagttacagagaaaactacgtacctcctatttgggtggtgccaggaatatggaaaccgatccttggcacatgcacttcggatagacacagaaactaactaggaaataaccaagattagtccctgatttgaggcgctatttatttggtaaccacgtaccgcgattccatgcatgcatgcactggaaagaaatctcacccaacagaaactctggattttttttctctcaaaccgatctactgctcaaccgagacgacgacgaccaaatgcaaagctcaaaactcagactgagctacgactaaaaccagcactttcgacacgacaatggaccaaaactcaagaacacaatactgaatgaaatttgaaaggctcaaactaaagtttggtgatggaaaaaaatattgcggctgtatggtagacgatgggaaaaaaattacaaaactaaaatcctcaccaagcaactgaagctctgataccaactgatgacgctctctctcgtggcccgatcttctggtgagggggataactctcgctttgatcgagtgcgacgtttgcgatgtggctaccaaccagaacaaatccaggacgccgtgcaatcgctacaccacaaacgatgtcgtaccaaccgtgacgcgcggttgatgatccctgcaatgcaaacgagagaacactgcaagaacaagataagatgcaatctaaatattgcaaatagggaattaagcacaaaggaatagttgcgattgaagtggtagatctaatcgacccggcaaatcaacacaccaactattgggggctctgaatctatagtcgccgactaatcgagcgaggactagagacaaggtgaatggcacttggcaaaattcaactaaacaaaacccaattgtttttgaggatatacaaagttatttatagaggaaaataaagctagggttaagtgctaatttgtggaggtggagggagacacttccgggatgggcctagtctattacaaggcccaaggcccaagttcggtttcagcaacagcactgtcttattttggtgattcccgttgactcgagatgaatttggacatgaaaccggatgcgtttgaaaggtagcgagataagatttccacgaagtccaagatcacccaaatcggagatagcatgaaggcgctaggtccgtttgaagtcagtgctgtctccggaggccgaactggtcttggacttgaaattattattggagcgtgtgaagttacgagcgtatccgacgaagtgatgtcctcatcaacaggtggtgtttacatactacacctccgattttaataaaagagtagaatattactgctactttgatcactcaattacttaactctggtaaagaaaacgtaacctattttcggcagcatttatttgaatcgatcaactgtactaccaagggcctataaaaattaaggatttgcatggggtacgaatttcatgaccccgcgtacaagttaattttcacatacggctctttcgagaaatcatccatcaaaataagttctagttgcccaaaaaaatattttgtattttaataggcatagagtattgttctttgggaagcgctaaaagtttccagcatctgacacatcctttcctagctgatcgactccatcccactcctgtttttacacattttggcgaggcgtatataaatcggacacccgtttttttaaaaaaatcggggttgttccaccaaatagatcggaattgtttcactacgttgattgaaaatggtccaatcgtttaaaaagcttaaatacaaccaaatcacctcataaaacattttgctacagcgcatgaaacaacggtttttgaagctatttcaccgcatataaaaataatgtttcagcaaatagcgaaaggatgtttcaattctctgcaacatttgatctatacatagtgtaacaatacgaatatacttgttgaaacattattggtgaaaaaaaaatgaaacggattcctgttaatagagtgtttccgtaatatgtggcagatttattgcaacagtgcgtgtggtggggcgcgtggtggacggaggcgcggtgccccatttttttcggcgcggaggcgcgggcacccgatttgaagaattttcagacattctgggtaagagaatttggtctgtagtaacaagttttgccacgcatattatccactttcccatgagtgctttgttcatgactttctggtcttatcacctcttcagctcttctcccatttctttctcttaataattagggaccaa

SEQ ID NO: 108934 - DNA, 885 bp, Oryza sativa
gtaccccgtgtactcgggccacgagaagccaaggaaacgggagaggtcacgaagctgagcgacgtggtgaccctcaccaaaaccgtgggaactgaagctggcgttcactgccatctacaattttgaaagagggagaaagatcagtaaccgttttagaaacaaactattgaaaataaagaaaaccaaagaaaccttagcttttcgcaagtagttttgaacttagtatccttagggtcgtcctaagcgtcgggtttcgccctagggccaagcctgtgctctgataccatctcttgtcacgccccgaactagtcccgaccgggactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactccttgtcagcaggatccacttcatcttcttcagcaactgggggggattatttatatagagcaagggtgagtacgggagtactcagcaagccaggggaaataagtgtttgatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtgtcagtctttaggattgcaacaaggttggcacccggccaacaacttt

SEQ ID NO: 108935 - DNA, 667 bp, Oryza sativa
  unsure (1)..(667): unsure at all n locations
ctgcagccctatatgcgcatatatgtacgaactactatgtatgttcgtatgtatatatgtacgcacatcgatctgcatgcgtatgcatgatcagtgtgttggatgcaataagtacgtcatgatgcagacgtattgagtatctacaaatacagatatatatgtatccggtgtgtatttttattacaaattactccctccgtattttaatgtatgacgccattgatttttcaaccaacgtttgactattcgttttattcaaaatttttatccaaatataaaatatttatgccatgcttaaagaatatttggtgatgaatcaagtcacaataaaataaatgataattacataattgtttcgaataagacgaatagtctaatgttagacaaaaagttaacggcgtcatacattaaaatatggaggtagtaataaataaagagctgtctgattttannnnnnnnnnnnnnnnnnnnnnnnnnnattttattatcgccaggtgtttatcaaaatcgaagtttgattaagtttacagaaatatatagtaatattttcaacagaaaacaaatatattattaaaatatatttaatgttatatttaataaaaccaatttagtgttttagatattgataattttttacataaatttggggtcgaactttaaaaaatat

SEQ ID NO: 108936 - DNA, 1636 bp, Oryza sativa
ctatgtatctggacacacagttgtccagattcatagctaaaattgcttatattttgggacggagggagtagatttttaaatgtttagtaaaaaaaggaaaaaaaatctagaatctcctgccaaaaaaggaaatcttaccttagttaatactccttctgtcctattttaagtgcaactatagttttcgtatccaacgtttgaccatccgtcttatttaaaaaactttaaaaaaagttttaaaaaataagtcatgtataaagtactatttatattaaaatacggagggagtacaaggtgtagacgatatcatatagagacaaaacctatataaaagttgtagataaggattagatctacaattttgtagttgataaacttttcatttgagcttatctatggtgctaaatatggtttataagtttggatagcagcagccacaaaataatatcatttgtttctaagacaagaactatttgtaggtttggtgttaaggtgactttgtgtgaatagagaggacttgagttcgaatatttcttgacacgtatatgaatatgagttgaagaaataatatgaattgtgggattaagagtgtgattgtataggagcttaacaaaaatactaattttttttcaattttttagcacctacaaaaataaaaaacggctgcacccttatagatgccagttctaaattcatagtcaataaccggcacctatctaccctataagccctttagaaagcaataggagtgaaaaaagatgggtatttcctagccgctcggccaggaggctcatgggaaagttactggatagaattatatatctgatattatccgagctcaaatccaaatctattaaaagtatgaattaggatatgaggagttatccatatgtatgtcctacattatcaaacatataacaaacaaactaaatgttactattttagttcaccagtaatattacacaaccgttttctcatcgaatcttttttacactaatttcctcctagacttattatctattattagagttataaatagatatttgaatatggtttcatgaacataagatacttgatgagcacctgacagcgagcgtcccgatttttccctctttcacagcagatataaaaatcaagcaacaacaaaaattcagagaataacttggtttggcttacaagtattgcaagccaaaaccctagaaaaatcctccaccggtgtttgaccaagacgaacagaagatgagatcctctagaatcaagtgacgaacccaggatttaatctcctgatctcgcctcctccttaagatcggcaacatttcaactctgtgtagatgggatcgccatcatcggtcttccaggaacaaagctcggcaggagaaacaccaagataaaaagcatgtcgaaccggactcagaaccaactcggttcctaaatgctagacaaaaataaatgactccctgttgatgaaaaacccatgctccgccgatggtgctggatctgtgttggcgcaaactaagtcgacaacaacgacgccctgagagatttgcttagcttcagtgcagatctaaaaattgataagatgcgagcgtgccagtcagcttgatcctacaactgacaagatatgtaaacaacagat

SEQ ID NO: 108937 - DNA, 1098 bp, Oryza sativa
aaaaagaaactacatatttttctaaatataaaaagaaactaacagactctttctaattaatagataaactgtcatgccgcatcctccttgaatcggtctcttataaataactttccataattaattaatttccttaatcgaatctatcaagaatccgactgctggcgacttgacaactcccgtcggccgattctaggattctgaagctgatactgactctaggcctatgacgacctcggggcttaccaaattttgacgttaacactctagctaatcacctctaagaataataaaataatatggcatctatgctaatctctactattataaaaattgaagatgtttttgccagtactttggtacgtcattcgtgaatgagtcggtttttaattccgttttcttttggaaatacatatatgtatttgagtcggcttttaagtttgttcgtttttgaaatacagaaaagactcctaattgcaggtcatgattttctaaaaaaatatatatacgtccaaacgaattcctatagtgaatttcatattaactaaaccatataacaataataaaattaaaatagctttcacccgttgcaacacacatgcattattttttctagtgtaaaaacaacaatagaaaattaagataacaccaccaatacctaagtattgaactctgatcgtgcgtgcaggaatataataatcctaataatccggcaccggtgcctaatgatctctgttacctggattgaaccgaggagaaaaaatgttgtctcaattccttttcttccttggccgtcaaggtagcattatcatctactgatttacaacctccttaattaacaagcacgggtttcatgtcaacagaaaattgccgtttagccatggacataacttgtgaaaaagaaacttgataataggtggtgtaaaattgtgacagtacatggtatataaattgttatgttccaaacatataaatgacttttcaatattgagatttataataataactacatatatggctgtgttcttttcccctctttcaactcactttcattgtttccgcgcacacgcttttcaaactactgaacggtttactttt

SEQ ID NO: 108938 - DNA, 1351 bp, Oryza sativa
ggcccaccagtcatagacaacccaggtcacaccggccttgctccatcctagtcctaatcggagccactactttaggtcttagaggcatatacaacctaaaagactagtctgatatgtaagaactatcctcgccttttaagtcgtgctcccccataatcaattacctatgtaggactaaacccaacaatctcccccattacaaatcggactaaacaatctccctcatcacatcaacccatctgaccccgaagacttgttaccgggctcctccaccatgtgacccatggaaattgttccagctttccaaacctaggctataataccacttgttagagtgtgcagcctaacccaccaaccatggttcacctaggtcacattgggcatgctccaccatatgcccaagcgaacatttcatttttcgtgtcgaagaattttaatactgactttggggtagcaagcacctccaacattagatggaactgcatttacttatctgaacctagattgggtactcattaagataaaaaaggcacagccgactattatctggaaatggttgatattaacactaatgaatcagaactgcaagcttcattgctcccatctataacgtggtacgacccaacaaataagtatttttgtttgggaatagatttgtgtgaatggaaagtgtgtgaaacattttgtgtgaacagtacatgtgcataacatttttgtgtgaattgaattgtgcacatattgcttttaaaaattagaattgtggcccaatccttggtccacctctggtcatggcggggtagaacgtgacgttggtgtccggtgaaatgcatggacatgaatggtggggctgcaaactggcaaatctgatatcggtaatgtcaaccatctgtagatgacggtcgttagtgtcttcttgatcttggtgacacaacatgggctcatataagtagacgcggttccaattggatattgaaatgttggacacaaagaatgacgtgtcttcgacatcttccaccttggagcaccatgaattctcacagaggaggtcacacaagtatatcattatttcataccttgtccagctggtcacatgcaaaatggcacccattgaagagatatcgctcgccattcatatccaggtagctatgttggtagatgtgtgcaaatggaagcaccaacagcaatgggctcgccgtgagaggagcaacaccatcactgttactgccactgaagatggagatctctttgagtgagctgatggcgacaaacccaaaaccctaaaccctaaatagtagagtggtaagctcttgcaaatccgattcgttagttgtaatgtcaaccatctccagat

SEQ ID NO: 108939 - DNA, 3082 bp, Oryza sativa
cagatgggcattatactgtacaaaggtagtatatgatttgaaaattgaatgtggaatatatgtgagccctagttggtttcagttgtgtgtaaaatgtcaagtaagtaaaattgtgcacattagcaaataaaatggaatataccacgaatagacactgcacgaatcttgatgaaaatttaatgatgttgacataggtgaggaaagcaacagtgttgttaaaaacccttgtcacacccatgcatgcccacatgcaccttttcatcgagcccaaaatgtcccagacattttctcatttgcgcggtaaaagacacaacaagcgggttatctacatggagtactacgtctatttgtgatcacaaattaacaaaaatacaaacaggcaatggaaataaaatagcaaaaaattgttcatccatcgttggtcactctatctcataccataaatgttataggagatatatatctaccatggcacttgagcaaattgagaaaagaaacatgttctagtgctaatgcctcatacctttcaaaataaatgtactgatttattcatataatccaatatgcactctagatgtcatgatacacaaccatccaaatttcagtttcatcctttattacctggctacgctgataaccttctctaggctcacctcacgcctacagcatgctatgaaaaagcaaagagaagtggaaaaaaaagacaaactctcccattaagggaagtgttcatctgtgaaaaagcaaaaagaagtgtgacgatgacggtgggtactctggcattcttccaacgaaactagccctgtcacgctagacgatatgagggaagtgttcatctatgagattgtgctctccacgacacccatggccgtgctcgcggactcctcaaattgaaggccacattctatcaagttgtggacaaggcatggtgttgatagccaactttggaactggatcaaatctaggctaaatcggtaaaaggattagagccttcatgccaagtgtgtcatgttggtttgatcggataatgaactgcggtcataccacacatttctaggcaatcagaccttcagccctgatccgagtccaatttagatactacttatgttttcttgcttgaggccggggttctcaagtcctagtgggtctctaagactaataggacatggagaagacccattagacgaaatatcacccctcctattaacgtaggggagccaaggctgattaaaagaaatcaataaaaactgcctgtattggtcatataaacatcctcaaaagtgtctctgcattggttaaaatgtctcaagaaaataccttttatatattaggtaaattataaattgcaaaaaaatgcctccataagaaaaacttaataaaatatgctataaagtgtatatagagtaaacgtattatatgtaaattttagaggcgatatgaaaattatcaaaaatatgaaaatggatgatatgaaaattgccaaaaataagaatgcatctacatggtgaagtgagtgtagctcaactggttaggtttcttgtgatggaactagcccactcagttttaagtcttagattttttttagtggtaggcgacccgtcgacaacaagatgcctatgttgactttatctatctcaagatacgctgacccatatgtatatggtgtttatttatagcggtgagtgtacgtgtgtctgcatttgtactatatttaaagaaaatgtttttacatgaggttttttttagtgcatgcctgcatcttccgagatatgcatcttgcacggcacttaatgtagtaatccttcatatcttttgtaatgaatgtagtggtttaaccacataatccgagatcaaccagatgtgtcattatggacaaccatcgaaacatcagttacatcctttacgaactggctatacgccgctaattctgcaggctgaccttccactgcagcatgtgtgctatatatgaagtatgaaaaatcaaacagaaataatgcgaaaaagacaaagacttcccagaaaacgctcagataccatatgccgatcctgagtcttcagcgagttcctcttgtttaatttgcaacatctagctattaattgagcacaaccatttgtactgttcagttcatataatcagaccacaacgacctggccggccggtcaccctgacaccgaatgtatttttataccacaccctgacatttcccattcttcatttaattttgattcgttgatgattatgtaagtaactcccttgaccaccttgaaccaccaactatagaagggtgtagtagtagactgaggtgctgcagcgagcgaacattctccagctagtgataagataccacaaatgatgcagccacatgtgtttttagtgatatagagaaattatataaagtgctattaacacttttgtacaaaataccatcgataaacatgagttgtacaatatgcattctaccagacaagtgtatatctttactttctgacatcacaattaccaactttatcaaaaaaaaaaaactaaccaatattttttttttgaaaagtgtggtaaaagacaaaccatcaccaatattgaacttttaaaagttgcattcttagtcatggtataccaacatggtttgttctttttcaagctatagtttcaaaaaaaaacatccatatatgaatttctagaggaatacaaccattccattcagcaattttcacaaaatcagcaatattcaaaaaaaaaaactcttcgtatatgaatttcttagaaaacttatttaaataaatttttctatcttatagcagttagttatttgtttgtgcccatgaatagttataaaaaaccagccatcaccgagccactaatttccaaccatggactcgtccgctacgagacacatgcagcaagtgaagtatgagtacataaagtatgactacgagacacatgttttgctactcaaacaaacaagatacaaatttgccacacagcaaaaaggttcaaagctcctttcctaaataaacaaaacaattttgtccactcatcgcatcactctagctatttggtgccataaatgtgcctaaagatatg

SEQ ID NO: 108940 - DNA, 1325 bp, Oryza sativa
agcatagagcccctaaaccctgaaatactggggtggaaagcttgcaattctaattcgttagtgttaatatcaaccatttccagataataaatagttgactgtgcctttttgatcttgatgagtacacgacctaggttcagataagtaaacgcagttccattgttggaggtgcttgctacaccaaaacctgtattgaaattctttgacacgaaaaatgcaatgtcctcggaattcttagacacatatactaacataatacaaaatttcactaattcaatgagagaacagtaactttcaaatttgactgtattttaagctttaattggtgaaaactttcacaaccttcttcccaaaattggaaattcatttcctccattaatctaaaatctatatttattggtaagaagtaccatatgtgttttagagttttatttttatttttgttttatgcattatttggtatttcgtgattggatacatgtgactttggtgtggagcatagggtgcattaatactgttgtcccaacacaatgggaaaacaaatgcatttcagagcaaacataatgcaatttagcaaatcaaaatccgtctaaaaatgttgtctagctaacttgcaaatcatgccattgattcatcaatgtcttggctttcatctactttgatcacagagatataatggaaaagtttggtttattaagaaggattgaggaagtgcagttaaataaaactatataagccgtccaaaatcaaaacttggatgacgcaagggagatctctaacatccctccatttcatgtactataccagtttttgatgtcttattaagcttaccacaccatcacagactgggaattacttctcttctgataatttcttgttgatcagtgatgcccacctcccccctacacaaaatcatcaattaactaagccacctaaaaaaatgatggacaaaacacttgtaaaccataagaaatgaataatatgaggctttcccttgttcctaacttggagaggtctataactcccaactaattgagaggtaaaaaataatcacttttactcatgtttatcaggacggggtcaaaatttttctagtatttgaaaggtatataatatattcatagtggtagtcaggagatatatacctccatcctaaaggtgtatacctcttaattaaataatgcaaatatccgggcctaaaaaaaatggaacaaaacccatagtatcacatctatatataaaagatgaaattccaatcatattccaacctataaaattagttttggtacatctctttatatatggagagttatatctgaagtatg

SEQ ID NO: 108941 - DNA, 1040 bp, Oryza sativa
aacaaccgttggataaaaaatggacatttgagattcatccacatcaccatgagtaatttttactcataagtgaatttgtgagtaaaacttttactttaatgattggatgaatctcagacgtctattttttgatcaaacggtagttttcaggtctcactacgtatgtagtttccactgtatattttcctgtccatcactaccaacagttgataatacaactgccaactggtcaatgcttttttaagaaacacggtataaacactgccactcacaatatgcgcacaatcatccctctgagtgcgcacacgcaaatctatcattgtttcgaaagcatatacaattaaactgtataattaacaatactatatgtatgtatctgctgcattctgaggaagaacaaaaaaaaaatacctcccgacgcatgatgaattcctgtctatctccaaggacaagtaaaagaagctccacaaaacaaatctaacccatatctatcgatcgatcgagatggatctccacttcccctgcaataacaaattaattaagttttattcaagatggccatggatgaaccggcgtgttaatccaaatgcctatcgttgagaagaaaaagaaacaaaaactgcaagaaataattaatttagtacctggtggcagaagtgatcgtcaatgcaaattaagcggagttgtttggggcaacatggacgtacggtgtcgcaaagcaaaaatggtgatgaacaattgatcgtcaaggccagggaactacctagcgaattaaataagcactttgatgcgtagtgtagctactcaattgtgctatcttcatgtttcgttttggcattgcctttcataaaggaatatatccaatgctttgctctttgcttgggacacacctaacgaataaagatgaaaggtagaagaaaagaaaaaaaaaagagctcaatcgattttttatttttttagagaagggtatattttgcccggtctctacatccaaccggatatatgcagcctttttaaattaggaacttagcctatcaaac

SEQ ID NO: 108942 - DNA, 545 bp, Oryza sativa
  unsure (1)..(545): unsure at all n locations
ttaagagcaagtttaatagtataactcactactacctccaattcatttatactcaatctaatagtcaatttatgcaaatagttgcttactgtactgttaatatatggtctcacctgtcatacacatattgcatcttagagttcgtgctgcagctagttatagaactgcagtccactgcttttctctctcatcttttactatctcactgaaatatatttatagttggctaatagtattctattatacctgctgctctaagcacgtggatactgaatgatcgtacagcagaaaagagctgcaagcgggtactatacaggaatacatgccaccactacaccgctacgcaaggatggaacgtatcggtatttttcagcccgaagaatcaaatcatcagcggtgcagtgccagtgcgcacgatgcacacatggagtcgacctgcaattgggncncccttttccaaaccccggtttttcaattgggaaaaacggatttctcacgggcgggcacgcatgggcggagcgtcacgcgtccgttccttccggtgc

SEQ ID NO: 108943 - DNA, 1120 bp, Oryza sativa
taaatcaagctggaatcatgtttgcctgcaccaaccatgatctgtagaatgcttttaaacaggcatacaacacaccattagggaataatctacaaggtttgggccatataacttcccttttatatactttcttttgcacttattttccaaatttatcggttgtatgtacatgatagataatactgtcccagcattgaccaatgtttgaagttcaattgtagcaggtccaatgcttgctttgagtacaaaaatgttttatgttttgacagtgcttttttttcaccagctacagatcaataggaactacaattatatttcattttgtcattcacaccttagcttccagttcactaaatggggatgaaggctgaagtcaacagagatatgaactgtagggaaaatgtaccttttgttactttgattaggaagattgaatgttaatttcaagatgcaaatggagatcaattttcagtctttcatatgtcagcttaagtttgttctgttaaaaatgaaatgaaacttgatttcaatgcaaatgctggggagggagttctagatctcaaaataaaatgctatctttgcttgctctatatgcgcttagcccctcatgagcggtgatcttcatgtaccatattactcacattacctgtatttttttgaatatctactgtattttttagagcatctgtgacggtgcaattataattgttcattcttgacatgcactatgcaggaatattgcttcaaggcaaaagaacgagacaacatattaggttatcccattatgaacagttaggttgagctgcaccttacatggtgggatcactatccatattttattacacacatgtaatctatttatttaaactgccctgtcaatccaatctactttatatccttatcttggtgctagcaatatattcaaatagctttgcaatatggatctatgttgattactacttatcaacgaattgccagtatggacatatgttgacaaggtgacatcacaacatgtatatacaacgtagaatctatatacatcaactgtgtcttgtgcttcacaactactccctccgtgtcacaatataagggattttcagtttttgcttgtaacgtttga

SEQ ID NO: 108944 - DNA, 1767 bp, Oryza sativa
aaaattaccggggatccttgatatgcttatagactaatttttgagtgatataatgcttaatatgaccctaaaacacttagaaatagataagctacccggtatccgaagacaccgggtagatacacgtaggtacgcccctgttgctctcacgtgtagaaaagcagaacaagcaaacagcaaactttgtagttttgcggctttgtcgcggaggccaagcgggccttgaaacaatggcctataaaacaagggttaacaatggccaggcggggcacggaggccagcgagccttttcgagtcggtctcggcatcctgtttcgatcttctacggtgccacgtttgtatgtttgcagtgttagggctttctttaccaaaacctagtcatgtttatgttttggcactacgaataatttgatatgatagaattcttagtaatgtgtttaggttgatacttagtcattttagcatttcccacatttatattgatgttaatgaatatagatagatatatatatttagattcattaacatcaatatgaatggagaaatgttagaatgatttacattatgaaacagaggaagtaccaattagaaaccaaattttatgttacgatgaagaaaattctagaattataccagattaagtatgggaattaccatccatttcgcttcaaaccaaaccatcatatttactattcaaactataaaaaaaatagcacggcacattttggcatcaatcaagtggcccttaatctcttgtcgtaaaattaaggccccgttcgttctaaagatttcctcggtctccattaccaaatatatttcaacctgtttaaaaccgtgcaaaaactttcttacataaaaggataaatatcatcttgaagtttaattatggcttttctaccgttttcctattcgaactagggcctaagtatacgatacatgagctggtactgacctgaaacatgtacattacacgatccgacagaagaagtcagtttgtttccactccgaacgagatcttccaagaaaccagcataaatccataatctagaaaggatacctttcaaggaacatgtcaatagactccaatgaatgttcccaataacaatgtacagtagatactggctggagtaccacataaaaatgtgcttcagttaacaagaacatcaaagaacatgcatataaccctttgcataaaaggggagcgtgctcaagttgttgaacttcgattaactacttcaagttgtgctcaagttcatgcactcgataacactttcacaaactttggtgtaaagtataacagctaatcctaaaaaaaataagttgcaaacagcttattcgtttgcattgcatcttttaccaatgcttgcaccaaacaagttgcaattcccttgttcacaagcttgatccaaccctacccgcatcgaccttcgtgataaaacaggtaaaagctattattcccactgatccaaaaataacctagtctcacatttgcaacaacctttttctggagaaattgatgtatcatgtccttcataggataaatcaagagcaaatataacgagggatgtgctccaacttactttgtaaatagtgataatcaccagagtggaagagttataaaggaaaaacaacatcatcacggctttggactctaccaaatgatttacagagagaatcactactaataagatgaatttacctgtagcagctggtttttatcagttttggcccagcctaccatttcatcgcctaccgtgaacaaatgca

SEQ ID NO: 108945 - DNA, 508 bp, Oryza sativa
catgggtctcgtcctctcctgcggttgcctctgccgcagccgtagccgtagccgtagcctgtcgccgccaccgccctcggataggctggatgttcatccatcgttctggaaatgggagaccgagccggagcgcggccgcgtcttccgctgcttcgacaccgacggcgacggacgacacctctcggccgcggagataagggaattctacgggtgcgggaaggccaaggagacggtcgccgcggcggataggcagaacggggacgggttcctcagcatcgaggagctccgcgcggtgatggaggacggggattcggaggcgctgcatgcggtgttcgacgagtacgacgaggacagcatcgaggagctccgcgcagtgatggaggacggggattcggaggcgctgcaggcggtgttcaactagtacgacgaggacggggacggtgtggtcacggcggaggagctgcggcgcgcgatgcataggctcggcggggtggatctgacggccgag

SEQ ID NO: 108946 - DNA, 569 bp, Oryza sativa
tgcaactttgatatagaaagttttcgtacgaaacacatcatttagcagtttgaaaagcgtgccacgagtatccaaaatttcatcccctctgcatagtggaaagatgtagtttttacgatgctccttatgagtagtttttacgatgagaaatggatgaaaatttagatacttgtgtcatgcttttcaaaccactaaacatcgcgtttcgtgcaaaaactttctatatgaaagttgttctaaaatatcagataaatctattttttaagtttgtaataattaaaactcaattaatcatacgttaataccacctcactttgcgtaaaccacttaatcttcatctacgggagaaaagaataccacataagtaatactaccatattaattaattaaatagtgataatagaatgacttttttttactgattgtagggctcataaatcgatgaatcaatggttaaccttaattttaaaaaattttaaatttaaccccacaacgccataataattactatcgataatagaatgatctttttttactgatagtaggactcataaatcaatgaatcaatt

SEQ ID NO: 108947 - DNA, 608 bp, Oryza sativa
cagcccatcccgatctcttcgccagttcttccgaatctcggggtcgagattccgtttaaggggggtaggtttgtcgcgtcccaaatcgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataattgaaaagaaataaacaaagttaaaagggttttataaaaagaaaaatcctaaaaagtcttctttcccccccttctttcttgggccggctcggcccagtccctccctctctctctctcttcccccgcggcccatcggcctcccccgcgcgcgcgccgctgacaggcgggcccgcccgccactctcgctgacgggtggggcccacctgtcatcgacttcctcccgccgggcccgccgccctgcccgtgccctagcgcctccgccggcgcggattccggcgcatcccgccatccccgcacccattaaagagggggaaatcactccccgtgattccttctcccgtt

SEQ ID NO: 108948 - DNA, 722 bp, Oryza sativa
ttcctgcagcccgtgggaagccaaagaccttgcctcaatcacataatgataagggtaagcttaaggcaaagtcatcatctggattgcatgatgatgatgatattgatgtgctgatcactagtaccttggttggaatcaaagataaccttgccaaaccaatacagactgcagcccctcaagatccaaatgcccctctatgggacatgctcaagaagattgccttagaacctgaagataaaatgagagttggactacacctttgcaagccagaatttcaagctcatcgcagttttcttattagcatgggtcaagaatatcttgaacgttgggtttacaagttcttatctggtgatgatacaggcctctagtgagctataggtgcatattggttgcaaaagctaatcgtggttgatgagggtctatattttgctgcacccttttggtcatgcaattgccgcactatatatgtgtttagacaattgctaaatattaacatagatactatgatgatgcatgctgtgacatgctaatctgctagtagtgttgctttctaacttttggacaagttgataaccctagctttgtggcccttttcttttgtcttgtttaactcgtggcattactggctagaactgatctgtatgatggctgaaacttgatgttaaatatattcactatttccctgttgccatttgcatgtttaacaatatgtgatgctttta

SEQ ID NO: 108949 - DNA, 804 bp, Oryza sativa
attcctgcagccctatgcatttgagctgactaatcagtttgaaccggtggaattactgaaagcctatctacaggaggtcaagagtgtgccacatttcaagactggaaagatatctctgcaagtacaggtgcacttttttcatttcaattttaaactgtatgataccctgtaaattttctttcacagaaccagggttcaagattgaagtgggaaacatagtaatcctggtctgctctgattttctttttttttaaaaaggcatggtttaatttagttccattttttccctcgaacatgcaggagggaatttagttgcgaaaattatcactaagaatttcaaaaccaaacactaaatcattgcaagacttcccttaaaaaaaatcaatatacacctgtaaaggctgagtgaaaatggagtcgaaatgaacaggattgcttgtagattgtagcaattctgttcgatggatcggttgccagttggtgacacatgcattcattctctaattgaatacgataaaagttcttttttcgtgaaaattacgacaatattgtgctggagtatttggactgaaagcaacttgttctctagtattctttcatgtggcaccatgacatcctgtcactacaatccacaaacggctcctcatgcttcatacctagtatagagattgttccagaatttccttggattgactagtttggatgggatttttcttagatccatgaaagtgaatcccgtgtagaactactagttacaccaacttttgtaagaagctctgaaccacatgaaaagttatttttttc

SEQ ID NO: 108950 - DNA, 717 bp, Oryza sativa
caattaaatctctagttatattttgataaaaaaaattaacaaatgtgccatactaaattgtggcttatcccattcatgttatatctctctaaacaaataagaaattggaatcatcctatccatacaaaccaaataaaagttagatcatcgtatccaacagagcatggatgaccatatattatccatgtatggctttgaagcaaacgcaccctatgtgatgggatgtgatatagcacgaagaacatagaacattaagatactgagtaaatataccatgttgaaatcaattgccaattataccccttaaagaaaaggcaaataaacgaaaattgactaagacatctatatatatatataaagttttcgcaactaatgttgtcacgaagaaacaaagaaatacataattctatatagcttatccagagggggaaaccctaagataagtataataaaagggtggttccaaccgttctgtttcctcttcaaagaatagaaaaaagaatcttttttttaactaaatttgacgctgttcttaattatgatgaaatcattcttagctttttccgtggattatggacaactatattaattacaaagtaattacatcaaaccaccacagaaagaaagaaaaaactcaaagaactacaaatcattcacacatctatgtttcttatttgtaattgaccagccataccaaaaaggaaaaaaaaaaaacaa

SEQ ID NO: 108951 - DNA, 737 bp, Oryza sativa
tgtgattgattaccctgaggctagtgatagtgaagatgagggtgatcatgatatgtatgctgctgaatggtcatggactaacaaaaaaaagccttttgtttgttctaacttaatgccgactcctcgcaaagatcggcaaagtgaggttaaatatagttttgatgtggccaagtgtgataagatatttgattatcttttacaagaaaaaaaattagattacctaaaggccatatcgtaccatctcaagaagaattgaaacgtcgagcttattgtaaatggcatgattctcattctcattccactaataattgcaatgtgtttcaacgacaggttcaatcggccatagatgaaggacgattgaagttcaccgatggctccaagatgaagcttgatcatgatccttttccggtgaatacaattaatttcaatgacaagaaggtgttgatttggccggagcaagccgaatctactaaaggaaaaggagtaatcattggtgaaccaaggccaaagatgatagtaccaaagaagccggaggttggtgtttggaaagagaataaaagtgaagcttcaacttctaaagctcctaggaagactaaagtgacccttgatatgcttttggagaaatatgaaaagcagggtggtgagagagctcacaacaaggggaaaagaccaagatcacctctttgggagcgatttgttcactcgctaagacggtcgcattcacctccgggggatcc

SEQ ID NO: 108952 - DNA, 730 bp, Oryza sativa
ttcctgcagccctgatattcctctccccctttagcatcaaagcaccaaaaagagcataataagggatatgtgagccatgagtatcattgaatgatatataaaagaatgagtagattgcatttgtgatacataaacttgttaggtgggtttaatttagtacataaacttataaattgctcattttggtgcacaaacttgtctaattcgtgcaaaccaggaccacaatggcttgaaaaggttaattctagcaagctaatgttgattagaatgtgacgtccatacgtatagtgagtacgcataagatgtgctatatttataaatgaggaatttcatatatttcttaccctttctaacccttgtatcattgctcgggttttcatatatgtcggctatcactatttctcattttatcttttcattgaacaggtgtatgtccaaatataaatcttctcaggtatgtgtttatcctaactaatacctaaatcaacaggattagccatatagtgtacttttggccttggtccaaacgcactggacaagttcatgcaccaaaacaaacattttacaacttcgtgcactagattacacccacaagttcatgtactgctgatacaatttactctaaaagaatcaataattcaagtttttaataaaacaaagtttctctcccctttgaacttggatttctcttccattgtaggaccattgaaattttagtaagtgaaagcac

SEQ ID NO: 108953 - DNA, 731 bp, Oryza sativa
tggtatacaccaggtcaactttgtcagacatgatcagggtcctaactggcgtgctgctccatttactagaactggctggtttttattgcttgatttccccctagattacatcaacatgcagtacatttgtctggttgtctcttctttcgggcagttggaggaatggtatgaaaatgacccaatagagggcagagttctggtcagagctatgtttaaggactttgattcagtccaaaggaaaattgttcttcaagatcccacaaggggtgctggtgaatcttggaccatctctatttttaccttggagggtgattttgctaatatttttccccctgatgaagaccttccccctgctggtccaaataatgatgaaaatcctgatggtaatgatgatgatgatggtaatcaggataatatttggcaatttggaccacatcctatggttcttgctgaagaagaccaggattggaatcaggctgctgtgggccatcaggccatggaccttgaacaggctgctcctgagaacatgggccagattgataacaaccatggctggaatctagttgctaacagaggtttaattttcacccttgctgatgctttcaaagatgccttcaattcctggtctgccaactctctggcaaatttagcccttcatcctgcaaggcttaattttaatttgcggaatgaaattgtgtcgtatgattctttttcttttgaattttttggtg

SEQ ID NO: 108954 - DNA, 752 bp, Oryza sativa
attcctgcagccccattttatttaattggttaaatgaactttgtactattcaaattatttctcgagctccgaaaattcgcgggaaatttcagagagtattttaaggcacaaagaatattacaaaatattctcggccaataatttttaaaggaaatttttaattccctcaataattcacttgattaaattgctttaaattttatttaatttctagaaaatacattatttaatgatttttaatcccgaacaaaaatcggggcgttacataggtgctaaatttgggtgtaaacagctgtcacattgaatgtttgaacacatgcatggagtattaaatgtaggaaaaaaaacctaattacacagaattgcatataaattgcgagacgaatcttttaaatctaattgcggcatgatttgacaatgtggtgctacagtaacatttgctaatgacggattaattaggcttaataaattcgtctcgcagtttcctgatgaaatctttaatttgttttattattagattacgtttaatactttaaatgtgtgtctgtatatcttatgtgacaaccaaacccaaaaattttccccaactaagggcctgttcactttgatgtcatttttaaccttaccaagttttagtaaagttaccaaaaaaaaagtggttacatttagtttgctgccaaattttgataactatataagaaatcctgctaaaattttggcaagttaccaaaatttaatatttttttggcatc

SEQ ID NO: 108955 - DNA, 729 bp, Oryza sativa
gcaaggccttccatacacctcattggttcaacacgctaagttaacacacagttttaagtatcctaggttgcattgatgtagaaggtgagtgctgcgtactgcctgagattttcagagcacaaaaggaactttgaatgcaacatgtatttctttcccagtgctgtttgggatatgaaacaactagagcagaaacagtgaagcatgccagctgaatgctgattactgaactaaaatgtatatgaagagtgtattcacagcaatctcttcatgaaaaaaaatagaaaacccaagtccaacataataaaaggcatatatttgagccccatcctctagataatcaatcatattactgcattgtctaagtgcccaaatctcaaaatagtttaccattcccaggtaaagtttgacagcatctccctgttaaattacattgctagaatagagacataaataatagcaaatggtatttcctctgataactgccaaaggagaagaaatcaacaattgcccaaacatgagtaagaaaagagtactccaattgatagtccgaaatcgtggatctcaagcagcgaggaataattacctcagatggtgacaaatccgtgagtagaaaacagatcaaggcgattgctatgatacaaggtctatatacgaatagatgatatggttggttgagttgttggaggtgggtatacatgcattttaaatcatggataatctttttgttgg

SEQ ID NO: 108956 - DNA, 741 bp, Oryza sativa
tctcaataatcaatagtcagtacttgatctgaaaatatgctataaaacatgttaaatggctagctacttttgagcaatattttatttttggacatattggaaccaccgactagttactaactagtcaacagccgctagtcattgaccgaccactgactagcgtctaggttaatactgtttcaaaaccatgcgggtggcaaatctttcaatggttatctttttttgtttaatgcatatttgcctcctaataatattaaccatatttcttagatattcgtattattctttttctaaaatagatgcacaaaagcacatcccagtatgtaatcaagctcaagggcaaggtcggcgaattgaatgacgtcctcttagcttgttatgctccagaatatatgatcatatatgttatttataagttagtaaatacattcagttaaattaagacctcaactgagcatataacatagcttagaagctgtggaaactttgctgccactaagtacaatacagatactagatagtgaggttcggtgtgcggctgccaaattataagtagcagcctgcagattttccatacaaattatctaaacagcaatgctacaattctgattacttgtaggcatctcttgctgcagccactaactagaaaataaatcccatggtatagatatatagatatatgaacaattattgaagtggtcagaatgtgttctctaaacatctgaatgacaaaaagaaata

SEQ ID NO: 108957 - DNA, 748 bp, Oryza sativa
gtgatgttagaggagacaagataaagataaagattaagtgttcacaaaaaaaaaaaaaaaccccaaaaaaaggggggttgggggggttttaaaaaaatttaaaaaaccgggtttggggtgggaaatttaaattttggaagttttttaaatttaatattacaaacttgaaaatagattaatctgatattttagaacaactttcatacagaaagtttttgcacgaaacacactgtttagtagtttgaaaagcgtgccgagaatatccaaaattttatccgctccttgcagtggaaacgaactggaagtgagaaatattagaaacctgcttataattgctttttgaagtaatgctcttgaagaagtaggaatccaatagagtttgtcctcattatcctgaggaacaatctgaacctttgatatgatttgcaccatttcctagtcaaaaatttgattgagcttgtttttagaccaagatctaaaacagtttgtaacgtatgatttccggacaaaaaacccatcattctactcacggataacacatcagcttctttaccagctaatcatgacacttacgggcttagagcattcctagctgcttgcttatctatttcgtccctcatcaacagcaataacatcagcagctaatctagtagatgcaccaaccctatctttaaatttagcatgtgtgctatcttggaaagagaaacaacaactttggtgttgctctcttcttacgggctgcaggaat

SEQ ID NO: 108958 - DNA, 1113 bp, Oryza sativa
tttgttgatccttttgctgcttatgagactgctcgagacattgctagtggtgagggtccctctggcacttctcgtttcttcaatgaggagtcctctcactccgaggagagcagtgatgatgaggagtcaaatgcccctaccgagaatgttcttacagatcccgatgaggcagtggacgccgccgggcaagacatcgactctcctcactccggcgacaccgagatcattccttctgatggcgatgatgatgaggcttgatcctcttcttcccttgtgattttgtctctttttggtgccttgatgccaaagggggagaaaattgcaaacgaaggggggtcaaaattttgtttttgatgcttactgcctgctatctgtataatccggaagttccggatcctcttatctggaagttccggacctgacagctccctctccttattgtcatgtcagcttatccggaagttcctggtattttatccggaagttccggacctggcaatcctttgacccctattcttaagaactcatggacatgttctaattctctatttgtgtgaatgtaatgtctattagatgctcttagccgccctttatttatactgctcttcatttatgctatgagtgtcttatttgttgtttgtgttatgatgttgattttatcctcttgagtgctcaccatgtcgtatcttttgcatataatatctattcttactgctttttgcatcccatgaatgagtagggatgaaggaaactctcctcggttgctcccttatatatatgcatatgagcttctctcatatcttccatatgcatacattaagggggagtttcatttacctttaaccattcaaaacaaaatttaattcaatcttttgtaagctttaaccatgttgtcatcaatcaccaaaacgggggagattgaaagtgcattaatccccctagtgggttttggtgattaatgacaaatgtggttaagggactaatgagttcattgagtgactttcaggtgcattagtccaaggtgtggaagatggatgcttggagacccccaaaaaagtacaaaatcaaagcggaccggaactcgagaagggcataggatagtttatcttttga

SEQ ID NO: 108959 - DNA, 1039 bp, Oryza sativa
ttgacttctttcttagccaattttgttttatgtttggaaaagtttataaaaaatataggaacattttcaacataaaacaaacatagtatcaaaatatattcaatgttatatttaatgaaactaatttgatgttgtagatattactatctttttctataaacttagttaaatctaaagaagtttgattttaaaaagtcaagatgacttacataataaatgatagagtaaaatgcatgcactcaataagattaaatatttttagggtagagaattaaaaaatgaattaaacatgaaggtgctactagttaattctatatatacataataaacgcgttatattatagaacattaaatctctactacttaaaaaataagaggtgcttctatcgtccgtcaaaaaaaccgtgggaaaaaaaaccgtgtgaaaaaaaccgggcaaaaaaagaaaaaaaaagactctgtccgataaaaaaacagacgaaacaaacgaaaaaaatctgcgagcgaaaaaaaaaaccaaacctgtccgatccaaaaaggcgaaagaagggaaaaaaccggccaaaaaaaagaaaaaaaatatgtccgatccagaaaaagtaggggcgaaaaaaaggaaaaaaatagaagattctgactccgtctacacggtaaaaaagggcgaaaaaaggaaaaaagtctaaacgaatccaactctgtcgacgcggtaaagaaaatggcgaaaaaaaataaaaaaaagtatctgtccgattccaaagaaaatcgaatcctattatatgtgacacagcgtggtaaaaaaacaaatcgaatctgattccatcaacgcggtaaaaaacaagcgtaaaatttttttctgtccgattccaaaaaaaaggttgcgaaaaaagttttccgtttctctttctctatctcaatctgtatctctatctttatctctactacttaaaaattaaaaagtgtttccatcgtccatctgtgaaaaaaagcgtgaaaaagaaatcgggcgaaaaaaatcgaatccgattatatgtgacgcggt

SEQ ID NO: 108960 - DNA, 1255 bp, Oryza sativa
ttttaaaaattgctaaaaatttgaaaataacttttcctgcttccgattattttatttttaacctatggaatttaatgaaaaataaatattttatttttaatctttttaatcaaaggtacctgcattttaattccataataataataataataataataataataataataataataataataataataataattcctttatattttttccccatctgtataaatgattaaaaatacctttacccgttgcaacgcacggcacagtaaaaaacaaaatcactctggacaaagtccggcacggcccggcccggcccattgctatcttccgttccacccgctcccgttgagctcaattatctctctccgatccccttccttccgcatccatcacccccaccactacatcacccatccccatccatctctcccccctccctttcctcctaaacttcagcggccacacccctcgcgagcccctcctccttatactcctccgccgccgccgccgcgtcccctcggtgcccccctctccgccgcccgccgatccggccccgagaggtgaggatccgcccgtcgctccccttcccttcgctcccgcgcgttagatctgcgccgccgaccccaccttgactggcccgcggcgcccccgatcggcacccccaccgtcgaggatgaggcgcgggggttaggtttccggtggccgccgtgcggtgcgcggttcgcggctgcttttttttttgggttaatttatgttgccgtgtggttcatctgctttagatctgcgccattttggttggggggaaacgttggttttgacgcggttggtacgaatcctgcgtgttctccttcggggctgtgattttgggggcggattgggagggcttattatttgccgtatgtgtgggtgcttctagtgggatgttacgtttgtgcgttggtggtggtggtattggtctcttgtggttcgatttggttcttctgttaccctgatgtgatgaatcactcgccgcacatcaaatttattcttctgcgttgctattttgtggttcaatttgtgcctggaaaggttgcaatttgtggttttgaaaatgtgcctggaaaggtgaaaaattatgttaacgatataccataaaaagctgagagggtggtccttgatctaattcgaattaagttgtctgagcttcattcaccagctgaaattcttctgttttaggtatcttgtttttagatctgttgacgacacagggctgcaggaa

SEQ ID NO: 108961 - DNA, 706 bp, Oryza sativa
gcactaagataaatcttgatctaatgctaactgatctaggataggatctctccttatatagatggagaactccttatcctaatcctaacataccatgactctatccaactgagttgtgttcatactgcaaaaatactacatgagcgagagcctaccactgctcctcgccagacctcctcctcgagctcctgcctcctcccgttcaagtggttgtgacgatcgcggtcatctagacggggatgaggttgatgggccttcttgatgatgcattttgaggagtacggtccaggtctcgactagggtggggaccgtgggcgtcctcggcaacttcgttctccgttactctgtcatcggtatgttgtcggggatctcgagcaggaccttgcggggttggttcggctgcggtcaagaaagcagagttgaggttggctattgtcgactatatatgtctgacctagttgtccgcctccgggaaggttactgggtcgaacggagtttacctcagtagagagttgaccacgcacggtgaagtgtttggcaggagttcgaaccggctcgactggttcacgtggtggaacaggagctcgcggttcatctccaaaacgaatctcgccctcttcgtgtatgtcctcgacgactctttcgatcacattcacttcgcatggggagttggatcctgaagattcctggtcatctaagttgtgaa

SEQ ID NO: 108962 - DNA, 578 bp, Oryza sativa
ggtacgtagtggtagctagggaagaaaggcagctccatcctcccttaagagtagcacaatgataggatataagtttgcttatgttgttgtttttttattttttttgcaaactagaaagggagcctacgcagatgcgtgggcaccttatttattatttatagaaataatgttaatataattaagtcatatctcactgtatgcatataataagttatagatttcaccttataattgaaaaaaaatctttgtcatgaaatagaccgtagactttaataaacaataagaatgtttcttatattcaagcaaaaatcacattttcttaacggattctatgtattcacacgaagtatataatctttttaaattgatcaaatctaacggtctaagataacgggtgcaccaacttaaatgaaaatcgacggtgagattataacatgttacgtagcaacctagaagtgcttgtaggagtgtcacatggcagcttacgagtgtttataggaaaattaatgaacttttagtatataatagatatgtaagagggggaaaagaggataaataagaggcttatttttttattt

SEQ ID NO: 108963 - DNA, 508 bp, Oryza sativa
taccacccaggactaaagatccctctttttagtcccggtttttgttaccaattgggattaaagatggattttagtcccggttatttcaaccgggacatctttagtcccagattcctactcccagttggaaacccgggactaaagggggttaccaaccgggagtaaaaaagatttcttcgccagtgtgctaaagatgagcatcttagtcccggatttctactcccggttggaaacccgggactaaagggggttaccaaccaggagtaaaaaagatttcttcaccagtatgctaaagatgggcatctttagtcccggattcctactcccggttggaaccctggactaaagggggttaccaacccggagtaaaaaagttttctccaccaaccgggactagatggcatatgtgctaagttcatagtattgcaaatttgcgcgtgtgtgtaagtaatggcaacatggacttcatgaactcgattgcatgttaattcatttgtttgcacagttg

SEQ ID NO: 108964 - DNA, 568 bp, Oryza sativa
cgcagccaaatgacgctcttgcccttagccatgtttcatctagccaaatggcgctgcggcatcatcatcagcatccgccggcgccgcctgagctgcagctcctcccggcatccaccacggcgccgttggccgccgcgtttttgtccaactccaccggttcctcctcccacgagcaacacgtgacgacgctgcgacgacgacggggcggcgccgcgacgacgacgacggggcggcgctgcgcgacgacgacgacggggtggtgctgcgcgacgacgacaacagcggcggcgctgcgacgatggcggcgacggcggcgttgcgatgacgacgatgatgggagcagcgctgcgacgacgatgacgaggcgttcctccgcatgccccctcctcctcctctccgcctcgacctcgccgctgtccttccgccgcgggcccagctccgcgtctctcagcgccgcgagcgccgccgccgcctcgtcgaatgcctccttccctccgcctacgccgccggccatcacggccgtcgcctcctcgggcgccgccgccacgggggtcgacttggccatggg

SEQ ID NO: 108965 - DNA, 754 bp, Oryza sativa
caataaaattaaaaaataaaaaggtctaaaaaataaaaaaaaatccagagggtggggaaggttgatgataaccagtgggaagcttggaaatgtggaggcaagggaaggataggtgtgctagtgcaagttcagtgtggtggatatctgggcagttttcttgtgtcagacaagcattattgaatagtttgattgcagaataaatttatctactcaaacggaaacataccaagaaaacatacacgacaagacagtacagtttagctgaacaactatcgaagagcaacttaggcaagaacactcaccatgctgagtttgtataccagcaggcacacaccagctcatggggaatgcaactactgtacctctatccattgatatttcctgctcatttcagttactacatgcaaactaatccaaacttgtaccatttatgtacaccctatttgcagcaataaccaaaactaaggaagctgagtgagaccatgtactataaggccacttataaaggaagaagagcagaagcaggtttttattttggaagaatagaagcaattaacaaatttaacacagaagcctaccgagtgaaagtcctaaactagaatgtttgctgcaaattagcttcagcaatcggctcatacagagacgtaggtgtccaatgttatttcaagcattccaaaatagcgacttgagcttgaagcatttgcccaagaacccttgaaattgcacatttacgcaataggcgcgcgctggttga

SEQ ID NO: 108966 - DNA, 983 bp, Oryza sativa
ttcctgcagccccaagcaatccccttgatcggtaagctatgtctgtctttgccaggttttttttttcttttgagctaaagagagaatttatattaatgactgatgactgactagggggttacactcctgacttgacaagtcaacgatccttattgccagttaagcaagcctattttttactatggccatgtttagttccaaagtttttcttcaaacttccaacttttccatcatatcaaaactttcctatacacgtaaacttccaacttttccatcacatcgtccaatttcaactaaacttttaattttagtgtgtactaaatacagcctatgtctttttcttgtgcacctgcacactctgcaagcactacactctgcaagtactttagaaatcagcattatccatgaggatccttatggactccttatcaagttaaaacaaccactaaaactagcacagtttttatggcacttttaacgttgcctataatactttgctatatagacatttttaggcatattttgttaaatctatcttgtagaggtatatttttggtacttcaaaatttttctcatatgtaaagtcattttctcaagacatctaaacctcggttgagtcactttctaaatattaatatgtgcatatatagaattaacacaacacatacatttacaagtaatgatataaggttcagataattagtgcattgaagataaaaataatatactcacgagtttaaggattggtaatacttcctccgtttcacaatgtaagtcattctagcattttccacattcatattgttgttaatgaatctagatagatatatatatttagattcattaacatcaatatgaatatgagaaatgctagaatgacttacattgtgaaacggagggagtagcaaggaaatatatttttttctattttcacattgctttgctataggtatggcaaaatttaatgcctgtgggctgcagga

SEQ ID NO: 108967 - DNA, 689 bp, Oryza sativa
ccatgttatatattttgatactactagttgaattactttgctattactgaagagctgttctgaacttaatttggtacccttcccttgagtacttttggttagaaatatttcaaattcaattaaccatatcatttactttgatgcaggccaaaatatccatcaaattttgatgcactactaaaaaactatatcagccttctaagaggttcacttttgaacttagtttagatcttagctatgcatctatgttatttatccttttttttttctgatggaaattttacttatagatctttccagaaagatcatgcaaggtatagccttggcattgggtgggccagttgatgcttttgaaggtagaaccgcaggagatcctttttgggtttgcaggttgattggttatcctgtatcaaccgatattctagaagagcatcgcactgacactggctggtaagcaaaatgtatctatgtatttatttggtagtatattgtgctagaatgtacttactagattcatctgacaccgtttttctcttatgtcacatccgttctgcgatcaattcagtggagctcacacagactatggttagtacttagtacatatctttcagaagttcctttcgaaatagacttttatatatggacaacacatacataaggtgctttgatgcattgtaaaaagtttcacg

SEQ ID NO: 108968 - DNA, 664 bp, Oryza sativa
caatcctattggtaccggactatctaggaggcactgctaaatagttctatagctatcggatagtttgttcctttatggggcaacaagtggttcagtgactgttggaaaagcataaaggactagataatccggccctatacaaattctagcaaactttttcaccgggaagaaacaactagttggaggagttagggctataaattggggtgctatggactcaattcaagacattaaaccccatttcacatgatgaatccatcgaagtgttcaagagaattgtgtgcttattgaagatcatttgtcttagagtgttcgctaaattctctcccaactctctccatttctatgatcttgagtttgtgagctaatagtgggttgagttgagagtgtgtggaagaaaagatttgtaatctcagagccgccaacgcgtgtggtttgcttaggaacccttgtgaaggctctatttcgcctttgaaagggaagaagtcactgagtggaagccgagcttcatctaggtagttgcttgccagaacgagcttcaccggagggtagttgcatgctatccgagcttgagaccgagtgggtctcttgaagcacgaacttttccttggccgttgcttgaaaaaaccaagacaccatcggaaggttcttggagaggaaaagg

SEQ ID NO: 108969 - DNA, 696 bp, Oryza sativa
aacggctaggttatgatggccacctaaaaggatattaggccgtaggcgacaaaaagcaatctagtccactagcaatggttgtgcgcatgggcggatttaccatacaaggtgtgggggccctggaccccactcaaaaattactggcgccaggtatatcactaattgtatgacatatggcccccagtccaacagataggaggaccccatttttgttacttgcattgaatccatgcgggcgttgaggacttgaggcgtcgaacgtccactaccatcctcttgttaatcccgcaaattagctcttcaaattaggaataggggaacggaaagcaagcccactgtcatttcgtccgctacgctccggcccaagcctcccggcgacgggcctccgctttactacggtagaagctagcatttattaagtgcaaatgaatttgtatcacaactcaacagattatcttcaagatttgtgctagtatttgcttttatacttggagattaaactatatcactagtggataaattattcatactaattacatcgtacttacactataattacatactgattacatatgtaaatttatttgggacttacatatgtaattttgcgacttatgtatataaatatgagagctacattataaatacactaaaattaaatatgtaatttaggaacttacaatataaatacatacc

SEQ ID NO: 108970 - DNA, 674 bp, Oryza sativa
tattcaaaatatcctaattaatagatacaattgcctttctgagagcttttctccatcgtggcaatccttgcgaagcacgttgatcgattctagaagcagttttacaactgtcttcatcagaatcggctaataagctgtgtcggctgtcctctgtccgatccatctcagccgatgccatcgcagctgatgcatactctgttctttgaatctaactctttgccgaatccactctgagtccaatgccaaacctagttcatatcttaccaaatttggtcgttaacactaatatggatacaaccattgctcacatcatgaatcaacaataatacatcaagatcaagtccttcaagtgctggaatccgattcagccaccttctacattgttgacttcaaacggccgccaaatctacatacgagctctgtttttggcccatgagtatttggtggaatgctcttggagccctctttccaaccgatctagcctcatctccatattccttctctgacagttgtaatcacagaaacaagatgtagtgtcacctatattgggccaatgggcttgaaattttgtttgggaccccagcccaagtggggcccatgtgaggtacgccccaactaggtggagcacaaacctagggacccctagttcattctcctacctccttaaatagcta

SEQ ID NO: 108971 - DNA, 1191 bp, Oryza sativa
aagtaatcaatattgcgacattgctgtttagatgatttatatggaaaatctgaaggctgctacttatgttttagtggctgcacatcttaaacccactatctaggggagtatctgtattgttcttactggcaacaaaattcgagcagcttctaacgctgcgttcgaattatggactttcctctcacgcacgaaaaacgagggtggtttattagcgcataattaattaagtattagctaaaaatgaaaattagattaatatgatttttaaagcaatcttcctatatattttttttgaaaaaaaaaacataaagtttagcagtttgaaaagcatgcgtgcggaaacgaggtagtataagttgggaagggggaagaaagaacaccctaaggctgtgtttgatacttggggttgggaacccaactccaccgcacggaaaacggagcggtccattagcgtgtgattaattaagtattagttaatttttttttcaaaaatggattaatttgtttttttaaagcaactttcgtatagaaactttttgcaaaaaaacacaccatttagcagtttgaaaagcgtgcacgcggaaaacgagggaaaggggttgggaaacttgtggaaagaacgcagcctaagcatgctagtgcatggtctaaccagctcaattcaggactcaggagatcttaatgtcacaggatgttagttactaacttccgaataatatatgtaattgcatatagtatatattggattatagcaagctaatacgactttattcaatccctttttggttgaatttgtcctcccgtttgattatttactgggatgtgctgttgtgcatctcttttagaaaaaaaaatacacatatatgagtattatggttaatgttatgtagtggcaaaatgcattagaccttaaaagatgaatcaatcaagagttggcaccgacatggttttgaaatatataaccgtggaattgaacgattcaacttttatgctggcgctgatttacacatctatcaatttgcctaagattttaaactttctcaaagagttgtacagaagcaaggccctagttcgtgatatgttgttacagcttgtatagctccagcaattaagcaatctaaaattattataatcacatacatgaatgatgatttttgtatggtttgaacaagcatattgcttattgtttag

SEQ ID NO: 108972 - DNA, 704 bp, Oryza sativa
ccactgcaaagctttggatgggaacatgtatcctgtggttttctaacatgtgatttgttttcagtaaaattggtctaaactattttgtatttgttttctgctttccagttggtttccccgtctttaccctcatccattttaaaaattacaaatacaaaaagtttatatatgtttaaatttgtcgacattattttgacatccagaccctatggtgatgcaactaatgtttggttccaaatttcccatagcataaacgttgtactttgtagtcgtaagattcactttgatgttagattgtgagttgtgactagtagatggctgtgttctttcgagggtgttgggaacccttctctcctagcacacaaaatgaagcggcggattaacacataattaattaaatattagcttaaaaaaattgaaatagattaatatgatttttttaaaataaattttctctatttaaaaaaatatattatttattagtttggaaaggaaagcgagagagtagaagctaggaaagtgtcccaaagaatacagtccagatcaacatggccttgaactatcaccgaagtttgtgtttcactcttaattggataaaaatcaccatcaactaaatatttttgtatattaatattttgcctagttgacatggatacgagcttgctattagcgactatgtccgaactacaccgggctgcaggaat

SEQ ID NO: 108973 - DNA, 860 bp, Oryza sativa
gaatcaacaaggttggagtgcaatggttaaatgaaacagtagcagaatcaaggttattggctggctggacagagaccggaagttccaggccaagaacaccggaacttccggcctgcaaaactgaagaacagaggatttaaccaggccagtgcatgtgacaaaatcctatagatcggcaatctacaaggtagcaggaacaattctatccaaaaggttttctccctaggttcacatatttagagatcggggcaaaaacatgatgaaccaaaggagaagatcaaaagtgctaccttgagagggaaaatcgcaaatcgatcgcgggatgaacctcctagccaccaatgtggttgattctacggagaggaatcaaatttccacggttggaatagaaaatcgccgagaggagcactgtagcggcggctagggtttgggaatcggggaggagaagaagtgacgagagagaaaagaagcttgggctccccctgggtagttatacccccgacccccggaagttccggactgggatgaccagaacatccggcctgacagaacagaggacagtcaggcccaagttcaaaggaatagatgagaattaaatgatttagaaatgaaaacctatggacataaagagacttatgatgtatatgaccagccaacaatcaacattacataataatggtcaatatacatcacaagaagggataactaccaaattttcgcaataaaaacacacacgaaaattttccgcaaaatttcacataagggtttttggataatagagtgaatgtttgagcttattcctggtatcaagaccatcttctacacaagaagtgatctcaagacgccaaagctcttttttt

SEQ ID NO: 108974 - DNA, 684 bp, Oryza sativa
atcatcccacataattcacatgaggttcaaatatatttttccatcattttttgtaatatcctatatacctatatagttaatgctattttttgtcttattaggccatatcatctcaattgtttttaaccttagataattaatctatggtctaaattacctacctccttttttttctctcataaagccacatcacattacttttatactatttaaattatcacatactatctcaacttatgtaagtttatgtcgtctaattattttacacattatttttgcttattgctatcatactaaactctcgcaataactcacagggtttcacttagtaagttcactatgagtgtatttggttgctcacgtctctctagcctagctcatctctctcgtcgagactgagtttgacctagttaagggcatacacatgtagttgtttggttgattgcatcggtttaacttggctagcatgagagtttgttagtttgtttggttgcttgcatgatagatataaaatgaaagagattttgtttgactggtgatatatatgaatttgagtgcagttacctcctcatttggttgggtgaggttacctctcacgtgaaaatatagaatttaaccggctagtgccgagtagataaacaatttatcacatgaaataataataataatattggagcttaaaat

SEQ ID NO: 108975 - DNA, 578 bp, Oryza sativa
ccacctgactgatctaagaaagctcgccatctacaagctcaacgtctgaagaggagataaaccttttgagaatctatatcctccatcgagtacctctgtggctactctctgcacaccctcgtaatcgaggacgtctcatcggagactctggaatcactaggtgatctttcttcccctcccaagtttctcaagtcccttgagctgtctggcaagtgggttgagctccccagatggatcacacagattgaagaactcacaaagttgactctctcggtgacagttctgaggacagataacttgagaagtatcagccaattgaaaaaactgttctctctcaccttttgcctttcaggcgcaaagcctgatccactgtcaacagccattcttgaggagaacaagaactactctgatggggaaatcttagttccagcatgaggatttgagaatatgaagctccttcatttctctgatcctctactgcccttgctgaactttcaggagaaggctatgccaagccttgagagacttgagctacggatcaggattctcgagggactttttggcatacaaaacctgca

SEQ ID NO: 108976 - DNA, 597 bp, Oryza sativa
acaaattgtgatttgcaaacacgctgacaccaccaatcgagttttcaaaggtttataaacccattttcctatatcaacaagcaagtgtgaagtgtgtggtattgtcgacacctatgctcggggcatggttgccgaggtaccattagggggagcgacaaaggataaccctaatcaacatcctataggtatagtgcaactattaggtaggtttgttagtttgtttcgtgaactagggcccagtcatatttatcatgcacactaggaatgcatttttttatttttttttaaaaattataggttaggagcaatatgatcaaataatgacttgcctctgtcttcattttcaaaatctttgaacttgcttgttttagactaattttcgtcgacgtggactacacaggaaacaaataaaaccaagcaaaactaaacataaaataccattattaataactaatcatgccattatcaatatctcatttttaaaaaaattagagacttgaacgaggttgatcggagttaccaatagggagatatgaagtttgaaagattacaaggtttttctagaattagaaacaaaattaaaggttttctgtgaaa

SEQ ID NO: 108977 - DNA, 515 bp, Oryza sativa
aatcttgtcatgtgttctatatggtctctttttcaatagtctttattttttattacgaatttcagttacttataaattgtattccttgttaaacttttattttttttctaatttctgaatttattttattttttaatttaaattttaattaatctcgtattgtgttctatatggactattatttcaatattccttattttttattctcaattttagttgtttcaaaatcgtattcctagttgaactctattttttattattctaaaaattttgtaattaactttatttttatttagaattttaattaatcttgtatcgggttcttacatggactcttcttctaatattgcttatttttaatttcaaatttcagttatttctatattgtattcctatttgaactatccttctcttttctaatttcagaatttattttatttttaatttcgggttttaattaatatcatatttgttctatatggacccttatttagatattagttatttttaattcc

SEQ ID NO: 108978 - DNA, 900 bp, Oryza sativa
ccgttgatcccaggttttggcatggatgctccagatcactccctgatggcggttggagggcactttggacatttccccttcgccaaccgtcatacctaccgctatataaagacatcactccctcacttcacttacacacttccaagcttgagctgaattataagaggctctattgtactatattgtatactagaataggaagagagtagagtagaagaagtcggaagaattccggagttgtcagtaatcttctcctatttcttttattctggttattactctgaattcaatataatattattcctaagtaatttagatttatcttgtgagaattatctcttggttagttcctaaatagcatacgggattattgttcactataatcaactaaaatatagtgattgctttagtgagttataaacactaaagtagatattaattgcttagacgtagtgtttaggtaattgttatacagtaattgttgaaacttctttttgagctgtctgctcctcggggcgaattctatgagccacctccttcaagagagagcaaagcaatggtacacctctactgttggatgtgtaagctgtagttgggagaagttgcgagacagattctgtctttccttcttcccagttactcgtattactgcccttcgagtagaaattctcagtttcaatcggggcagcctgtccagattcactaatttagtgcagtccggaccaaccctatccttacccgaatatgtgctactgcaacatttccatataggtttggataaggagtctgcattctatctggacataaccgtcggaggatcgttgatgcacaaaacgccgtcggaaggaagaacaattttggatcatattctagaaaatacttccttcatgacgcaatctg

SEQ ID NO: 108979 - DNA, 716 bp, Oryza sativa
attgctccaatataattcgcatccctcaatcgtgataacaaatatattaaccctcaccccctaactattgaaacggatgtaatttaattcccttagcggctttgagagttgttttcgctaacatggcatgttgacggctgactcaagatgtggaacccatatgtcagtgtcacatttccttttcccttcccttttcttctctcactcttcctttcctctctgctaccatgacgacggcagcctcgagaggccggtcagtctagatagtggcatgtgcggcaaagaagctagcgccctgacggcgggcatggtcaaccatcctcatgccccctacccacgtcgacgtcaaacagtattagccagcatccccacctcctccctctctgccctggtgtaggcatcgagctcactccctgccttcctctctagtggtatggcggggacgtactagtcaaggaagtcgaataggagacggttgatggtgtcggcgctgtaggtggcgtcaatgagccatccgatcccaggttaggggagagcggtgttccaattgagggcaacgctttgggctcgagcttcggcgccaaccggctctagtgaggcccacgtgcatggagacggagtggatatggcggcacagacgctggaggaacaagcatggttggagaaagcagatctagtggcaggcaagatgctgaatctcgagtaggggtgaaaac

SEQ ID NO: 108980 - DNA, 712 bp, Oryza sativa
acaaggaattttatacaggttcaggcgcttcttattcaagaagtaatatcctactcctgtccggggatgattccgccgagtatgtaattgattgtatgattgggaaaaaagaatcgtcccgagaggaacacggacccctccttatatagggaaagggatctgtaatacaaagtacaatccatatcctaacagaatatgggattacagataaaatacaatcgtaactgactaggatcccgggtagtttcttgacatacaagtttagaatctaacccgagtcctcgtaaagatattctatctatatttggtaccgtatatccggctggaatataaccgccatgtagatatggggtaatcataatctccacattttctttgagttgcactcattttgagtgatttagtgtaataattgattgtaactagcttaagcaaagatcaagatggttttctatttcattatctaaaaaatttaaataaaaatatgataaaaaaattgccgtccgaatatgaggatcgacacatgtttgttgccttgcagcattgctgagacgaaagcatctttgatactccatatgtctagtatacaaatgcttccaagtacccaatctaacttttggtttggatcgttttggttggtatgggatatgatgggctgagattccatcttggattggagtggattggactcccaacaaatgtgggttggatt

SEQ ID NO: 108981 - DNA, 640 bp, Oryza sativa
tacctccacaagcccaccagaaatcctaatgggcgatcgtccccccgcacgatcagccctcctcacgtgggatcctttttttggggaccgcattactttcatattttagtaaattatgcacctaaagtttggtacacctcaagtttacacatctaaagtttatacatctaaagtttatacacctaaagtttatagacccaaagtttataagtcaaaagtttatatacccgattcaaatttgtatttgaattcaaatattttttatatatagtatttctagatataaagtttatacgtgcccaaagtttataagttaaaagtttatatacccaagtcaaatttaaatttgaattcaaatattttttatatatagtatttctagatataaagcttatacgtgcccaaagtttataagttaaaagtttatatacccaagtcaaatttgaatttgaattcaaatattttcatatattgtatttctatacataaagtttatacgtgcaaagtctatacacataaataagagtattagatttatttttattttttttctaacttgtgttttttatttttaaaatttatggtgtagtaggaagagaagaagggggaggaaggggagaggagcgtgttagcggaggga

SEQ ID NO: 108982 - DNA, 785 bp, Oryza sativa
ctatacatatagtgcacacatatatgcatgtgtgtaatatatacatttctatattatgcatatatatatatatatacatgatatatattcatatatatatatatatgtacaccaggcagcacaacaaaattaaaaaaaaataaaagaaaattctttagtctaaagatggctttgccggccacgtggctcagccatctttagtcccggttggtgtcaccaaccgggactaaagatggagatatactcccaggtatttgaaccgggactaacgaccgccatctttagtcccggattctccctcccggttcgctacccacgggtaaagggggttgcgaaccgggagagatgagcacttctccagtagtgatttggttgcttcgacggtgcatttggtcatgctcttaagggaggagactcaggagaaagggccgaacagggcagtgacactttgaggtggttgaagggggcggcggggcagggaggttgatttacaaggcgaaggaagatggagctagggctaggtaccaatctccggtgcagcttgctctaccaaatcaacctcctagcaaccaactcatattcattcaccaggtattccacttccttttaaatgtggagtaacttactcacaaacttttgtgggctatgcaaaagagaaatagcttgagggtgacgcctaatcaattaggaagagaaccttgaagagtaacaagctgacagatgaaggtcagatggccattccaaaagggctcaaaatgcaatatatacctagctctgagtagccc

SEQ ID NO: 108983 - DNA, 610 bp, Oryza sativa
agtgtcctacgggtaaaaccacgaaatcatagtgtcctgtagtaaagtgtgcctttttgaaaaggagggtcaaataaataaacaacaaaaaagtagtatgaaattggtagttagagttcaaaacgaggtgaaataagcaattgttcctataatataatctatatctatctctatactaatataaaaagcaccagttgtttctttcttacatctacatagaaaagtgtacacagaagttttctaattgttggatcatctaatctaactacgtaaattacaagttagattaacattgcgattagcgtctgattaatagctattagagcaagtataatagaggactataagaaggctaaatgctgaggtggatgagagatgagaggagagagatgagcacttacaaccagcttaggcacatgaaccaagaaaatttgtgagacagacatgtggaccatatatttagatgagagaggagaggagagagatgagcacttacaaccagcttaggcacaggaaccaagaaaatctctgagactgacaggtggaccatatatttacaatgaagagctaaccacgagtacgaagggagtatatgagtgagctgagagag

SEQ ID NO: 108984 - DNA, 682 bp, Oryza sativa
aagttacacaccaaaacctaataaagtatatggaggtaataaatgttttttttaatattgcgcacacatctaaatattgtttaaaggagacatttatgcaaactatatattgtggtgtaaccagacatccacctgagctaggacagtgactagaagagaacatctgcagtctgagagtatatacgtacgtaggatatatatatgttcatatccggaatgaaataaatacacatggacctgtcaaacatttgttcctttttagctagctaatagctgtttaaacaagcctgtcaaagggagcatgcagatgcacaggcacaggcaggcagaggtcaaccaccaaacgctttgtttttgtgtcacggagtgcagctcagatccacacgacaagggggtcagtgtcccaagcgagaaaactattagggcaaagaaatgcttttggaatccagccagattggcagattgggtcacatgaactaaccagaggctagctcagctgctcagctcagctcacactcactcgtgcatggatgcatgcaaaacctaataggaaagcaaaaaaaaccaagaaaaggatctcactgctgctatgtaaagtatgcttccaccatttagtccatggtcaccttcaccaaaagctcttgtgcttagctactaagttaattaatttgtagcctttttg

SEQ ID NO: 108985 - DNA, 649 bp, Oryza sativa
tggtgcaccatgaccggccgagccatcaccaccgctgtcgcttcccaacgccacaaccagccgaagccgccgccgccgtcaccagccaccgttgaagcagaagccgcttgcccgccaccgccaccagccgttgtcgaagaagaagtcggtcgcctgccgccgccgccgccgtcaccatcggtagcctagagttaagttggatggagatttcgggtacatgttacttaggccgagggcatttatgtccttttgaaatttctatctcctctttttcactgaaaatgataaaatattgtctcagatttactatagctaattacacaaattttgtggtgcctattagtagtgtcgcgttttttgagtgtcttctagctaattacatagcttagcttttagatgtccgtggcaaattttgcctgatgcttcttttttttttttactaattagtttctttatcttcctaagttccaagctgggccttaattttcattgcacatggcatctgctttccattctcaaactgcaaagcgacgcgacgcggcacgacaccaaaaataagtagaagcgtactccatactctgcactcaaccatggcggaggcggccaccggtgcaactgacacgtcactgccgccgccgccgccgcacgt

SEQ ID NO: 108986 - DNA, 723 bp, Oryza sativa
aaatggcactcgaatgtaaaaaaagaaaactcaaaccctaactttttttattttgaggatgtaacatatgtaaaaaaaagctcaagaattatagttgattttatattggagatttgttaacacaagatcttataaacttttataagattagctataatcttatccaacaaaattatgtgctgcaatcaaagaggccaaattttcacatcccgtgtgcgcctccgttaccgcgaaatcaaaatgcctgccccgccactttttttgatgctaaaagtcatttatgcccataccagctattgaactggcatacccaaatgaggtcaatttaggacttttactcactcgagtgtgacacatatataggtgaagctgaagctaaccctagaatcattcccactccctccatctgcacagccgccgggcaagaacaaccttcttgcagatcttgctcggcttccaaaccggccacccctttgcttccctcccaggagcaagacgatgggcctgggaggaagatgctcggcggcaagaacaagcctccccaccctccttctgtcttccagatcctgcggcaaccccttgcctccctcctaggagcaagacaatggtgcttggtggcaacagcacacattcccgccatccttcggtccttccagatgaagcggccgccatggagatgctacgtacttctcagctcatccttcttagggtttcgaggcttgg

SEQ ID NO: 108987 - DNA, 536 bp, Oryza sativa
gacgtaccagctaacacaaccggcacaaagaatagcgaacggtcagcaatcacgaagaaaaggaagggcgagagaagcgtgaatagaaaggatgaagggttccatgttgttacccatgtttcgcctaaaggagagccgctcgacgctaagacggcacgtgcgaaattcagttcacagtgtggcataatattaagggaaaagatccccatcacggtcaaggactgggatcatgtatcaaatggggataaggaagtcctatggaaagagttgaagaaaatcttccagttcccggatggatcagaggcagcagtgagaaattgtgcactgtaaacaatggctaagtcttggcgtggttggaaaaccaccttgaacaagaaatttgtgaagacgggacgcacaccattttcgacgtatgccaacataacccccaatcagtgggacgactttctgaccttgaagaactctccaaaagaaattcaaaggagccaaaagtatgcagagttggccaagaagaacaaatttcgtcatcgcttagg

SEQ ID NO: 108988 - DNA, 1057 bp, Oryza sativa
tgcgtttttccgtgcgggcgacggtctggcgccggtcccctgattatctcgtgcagtgccaattatggcctgcctggaaacaaacaggtccggcgtccatgaaaatgttttgtgtagtagtgatagtaaacatttgctagtgacagattaattaggtttaataaattcgtcttgtggtttatagacggaatctgtaatttattttgttattagtctacgtttaatactttaattgtgtctccgtatatctaatgtggcacgtcaaaactttttaccgctggatctaaacacggcctgaatctaaacctaagaaaaatagaatatgaactagactgtacaaaatctataaatccatgtgcacgtactactaggagaaaaaaaacatggcctagggccttgtttagatcccaaaaaattttggccgaaaacgtcacatcaattgtttgaacacatgtatagagcattaaatgtggggaaaaaaccaattacacagtttgcatgtaaattgcgagatgaatcttttgagcctaattaattacaccatgatttgacaatatgatgcttacagtaaatatttgctaatgacagattaattaggcttaataaattcatctcataatttatagtcagaatctgtaatttattctgttattagtatatgtttaataccttaaatgtgtgtccgtatactttaaagtttttacaccctaggcgatgaaagaaagttgcacgcataacaccagcaaacagttttgtgtgttgtgcaagtttgggtacgtacataaactaggtataggggcaggagaatcagcttacatgaaatatgcttacaattctttaatctgtgttcaggacgatgggatcagattccaaaagaaatgaagcatttccattcaaaaaaaaaaaagaagagagaaatgaagcatttgaggtttcctttcgagatagcaatgcagtgatcaccaaaagtcagtagtgatcaccaaccaaatttgagccgaattcgtttacgaacaacgaaatttgccaaactaaacagcattattcgtatggagca

SEQ ID NO: 108989 - DNA, 1456 bp, Oryza sativa
ggcgccggggctcgccagcagcacgacgtgcggccggttatcctccgccgtggtgctcgccaacggctccatcggtcgtctgtaagacggtgtagtgtgcgactgtgtgttgtgtgtagacgacaatacgagtcgtatatatagcccacggccacgcagctcgagaaaacatatgcgtcattagcaattccccaattataattgtggcagttgacgatatcttttcttcaacaaagctaccggtagctattagtgaacagtgtgccccagaacctagtgaatcttaaaacgaagaaagattatgtgatagtgtagcagccggcggcgatggctcctacaagacaaatctcggttttgatccttctcggacctgtttttttagtaactatataacattcgacagttatttttaaggaaaaaaaactttcacatgtaactaattataacagttattactgttttgctatacttttttgtgctgttcagctgccgatgtaatagtcaggctaaaaaccctaccccttagctctagtttcagtgctgtcttttgaggttgctcttgttgtcttctctacaaaaccagctaatgtggtagccttatgtatctttctgtctgtacccggaccttatagctctgttcatttctagttatggaaatggggcgtcagcccttgataaaaaaaatagttaattacaacgtatctagtatgaaattgttatataactattacataactaataacttatatgtaacttgatcttttctttcaaaaccacatggcattgcaagtgcctagcgtagcggtcttgcaagcaacaagtcaagggttcaattctcgcttgggcacgtgcgatttttttttatatctcggtatcacgaatctcgaagaacatccgacggtggaaaatttgaaatttttaaagaaataaatcagtcgaaagtttttttagcaaaacccttttttttgttaaaagacatttaaggacatgtttgtagcatcttgtgattgtagtagtttcttcgtcatatagggaaagtgtttatcatcctatcgagggaatactcctagttttttatatgctatctaaattgttataattttcttttaaaaaataaataagatagattaatatgaaatactatcactacacaaatatgcaaattcaaattaaacttctacatgttgtaacaaaaataacacataattataaacatactttaattatttttatttttatttttatttttttctttttttggtaatttgtagaggttgaatttaggtttgcatgttaatagagtgatatattttagagtaaatttcacaaaactacaggtaatttgatcaatctactacaaagctacatatttaataaagtgtaacccaaaactacaaatttaaaatcatatttttcagaaatttataaatttaaggtattatatcataaaactaca

SEQ ID NO: 108990 - DNA, 611 bp, Oryza sativa
ggcgaattaatgtttcttctagcgaattcgaaaaaaagaaacacggcgatatacaatagagtttctagaattatagtggattcagtttgtttgcatcgcactactaggaaaagcattatcgcaagcggccgaaaagggtcttcgcaggcggggcgatcgtccgcctgtaagccaacgactgtgaagatctccgatcttcgcaggcggggcggccgtccgcttgcgaagataattttcgcaggcggacgttggctagtccggtccgcctgcgaaaataggaatcgtccgcttgcaaaaaaaaaaacttccgcctgcgaagataggtagaaaatattgaaatttaataataatttgcccgtaaattacttttaaattatttaatagaaattcttgcaggtagatttttatgtacatatatcggaagattatcaagcatttggtactgagaaatctacatatattgcataactcaaaagtgttgccaaaatatatatatatattacaatatttttttacattgtcacttcaaataacgtcatctagttacgttatggcatagcagtgttccactcccgaagatccttgaattcgtcacttgccgctagggcacc

SEQ ID NO: 108991 - DNA, 760 bp, Oryza sativa
ccatatttcgtacttgtccataaatccacgagttactaagtgctccttcactttaaaagcatcgtcaaagtccgaggctatttcattcttacagtcagcacatggacaaattatcttcctcatattgttcttctcagggtgtgccttagcaataccaataaatttagccacttcgtttctatatgtagacaaaaacctcggccaatgatacatccattcccgactttccatatctctaaaaaaatacacgtaaaatatttgcacaattaataccaaatttgtagggtttattgaaaaaacttatcgctattcaaaactaattaactaaagttaagtgtaaattaataaaaaatcatagtttatttcaattttttttacatagacatgccaaattagtacattaggaaaatctacaaaatcatttcatcggcatattacaaaatactataactattttttgattgcaccgaataaatagacatttaaaattttattctctctctgtatatgacaagatctagatctagatctagaactaggtggtggatgtgatagcaaaaataaaaaaaatttgagaatttatgttaccacattaaaccactacaacaagaggcatcaagtattacacatacatctaacatcaacatatcaaaagaaataaaattaaaaacatggagctcttcctttacaattttgcatgcataaatccatcacaaattaaggtctaaaaagcttaaaaaattgatacctagtgttgaaa

SEQ ID NO: 108992 - DNA, 890 bp, Oryza sativa
ctttttccgccgcgtgcgtgaggaagaaggataggagagagatgtaggcccatacagcgtgagaccaggtggttaaaacctattaaaaaggacactgtctataacgagaccattctctctatggtcataactagatacctcaatctcatatctagttgctactagtatactcaaaagtgaatgtatttttttttcttcttatggaattttctcttagattactcatccgatttacgatccgattacaccattgtgttcataacaattaaatctttataacaaaatctcacatgactatatttttatgaaaaaatagaaattacttttataatatatctaaattacttttagattttattaaattacttcttagtcataaaagtaattcaataaagcttgaaagtaatttagctatattatagaagtaacttgaaacaaaagtgaagtaacttgttacgacattaaaagaaatctatacattcatgttgtgagttgtttattttataatcatttttagtcaattatgtaatttatgctgattaaatttaatttctatatagactcatgtttttacctccataacggatttacttttaatgtcgtgataaagttactttcttctttttttaagttacttctataatatatgtaaattacttttaggctttattgaatttacttttatgggtctaagaagtaatttattgaaatctaaaagtaatttaaatatattttaaaagtaatttctattttttcatcaaaatataatcatgtgagatcttattataaagattcaattcttacgaacacaacggtgtaatcggatcgtagatcggatgattagtttaagagaaaattatttttgaagtcgacgtagcgtagagcatcac

SEQ ID NO: 108993 - DNA, 703 bp, Oryza sativa
ctcgacgacacgctccgggaggcgcacgagcttgtgttgtcgtgccaggacaagagcgccgtgtacaggttggtgatggccgggggcaggctgaaaagttcagggatgttcagagcaggatcgactctacctctcttttttccagttattagccacatggacatcactcgccgtttcgatcgaatttacaacatcttgcttccaaacgacatggccgggccatctatgtctcctgtctccatgccccaaatccctgtcccagcctcccaggtacacattgaaatgcatacatatataatactccctctgctcaactttgatcgtccgtcttatttgaaaaaattttataattagtatttttgttgttacgagataataaaatatgaatagtattttactcgtgacttatgttttaaaattttttcaaaaaaattttaaataagatgaatgatgaaagttgggcatggaaaaatcatggctgcacttaaaatgggatggagggagtatatatatcctcaaactttcaattgcactttgtacttggcttcaaagggaagcttagaagttagaactcagctctaattttaccattcttccattatgtgcatttctctatactaggatactgctaagatctgttggaactggaaggaaccccatagagtccaagagtttaattttaaggagctcgcaaaggcgacca

SEQ ID NO: 108994 - DNA, 705 bp, Oryza sativa
ggggggccgcctgcaaatgggcggcgagggggcatggaattttgcaggcggcccccttgccgccctgcgctagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatatttttttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggctttcattttcgtgtgttgtgtgatagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgttgtgctgtgtggactgtgcgcgctactggatctgacactaccgtgcaccgcccaaagtg

SEQ ID NO: 108995 - DNA, 1138 bp, Oryza sativa
ccatgctggcgccgccgcctccattcatgtttctttgtatagagttgcaacggtgtcatttttattttatttttttggatgttttttcacactcaggatcacgatacaaccaaccacaaaaaaaatttaaacttgaactaccacttagctaagtctaaaaatagctagcgtaccacttagtctactttgcaccttcactaaaattagaccataactcctttagtaaaaccctttgatcagcatgttaaacataatgcactctaccattatatgaaattacttaatctaattcaaaatataaccacatgaaatgacatatataagttaaacagtacataaagatgcaatttttttatttttattttatttttttgatattttttttcacacttaggagaacataggaaccaaccgtataaaaaataaactcaaacggacaaaatatgtgacttttagaattttccaaaactctatcgaaacggacaaaatatgtcatctattaaaataggcgtaactttctcatacggacttggaatcaggcaaataatatatgcacggacatctacagaaaaagttacatccgattctccctgctttgctgggttcggcgatattaaaacctccaaattccgcttgcaagattgtgttttcgaggagagaagtttttcggtagagctttggaaaatttgacatgccacatatttcgtctgtttgagtttattttttacatggttggttcctgtgagttcctcagtgtgaaaaaaatatcaaaaaataaaataaaaataaaaaagttgcacatctctctcctctgcactagttcggagagaggagaggagaggaaaaattctacaggtcacatattacgtccatttgagttcaatttttctatggttggttcttatgtgtccctaagcgtgaaaaaaaatatcaaacaaataaaacaaaaacaaaaaatttcagggggggtggggcgccagccactatggcgcactccccctagccacctcagcatcgcctgtaacgtcccgcctcccccaggccgggcccacttacatctgatagctttcataggtcatagactgccctcacagaccaacacatgtcttttctgcacacttttcctcactcgtgtgca

SEQ ID NO: 108996 - DNA, 3553 bp, Oryza sativa
ttgagacgtgttacctcttgcgaagcagagtcgtcgaaaagtaaaaacaaaaagggtggcaatgtgccgaagttgtattagattatctcctatattacatagctatggggttcatatttataccccgagtacaaacttagtccattatggacacgactcaaattttctaaagataaaatacaaacaagaccatatacagtggtctcttaccaaaactaatcacaaccgacttaaactaacctaactaatagatacaattgccttatttaagctctatctctaattggcaatgactgttacctcaatctaggccctgctgagcccaagttatatctatcgtctacttgccatatcggccaagttaagcctttgttctttttccagccgatacgacactcagccgatgtgcagcctgacttggagatcaactcgattccacaccaaatccgtctcgatctttcttcttcctctccaaatcttatgcaaaattctgtcgttaacagttacccttttttttaacatacgcatggatcatatctctccttatcttgccgctgccctttctgacgacactggctcctgctgccactagagaatctcttaccagccacagtggtattgacgaaatatttcgcctctaatgtggaaaaacggaagacttagctgatcctctgcacgaccgtatcatcaatctgcatgttaatatcctaggcgaccctcatgttaggactttcttctttcaaccatgtccctttttttaatttgatccgacaatttcgctaggggaaaaacttatttttgttgtgatgaataatggtttggcagttgatttgatccatgatgagtagtccttgcttctcgtttcgacggcttgtggaggaatcatctccgacaacgacgatgaattttttttggccgcaacgcaaattgtgcatagctattggcactctgtcaatgcaccaaaacatggcggttctatcatgggtcatgaatcgattgatcgcaacagagaagcacacacttgagaggataatcctacctacggtccagttttattcaagcgcggaattgtattaagccaattttttttgatttatcttagctatatgctatgtctctcattagttatacttggtaggaatagaatgaaccgacctctatttctctgcacaatgaatgcaataaaggatcacgatgactattttgtgcagaagagaaatgcagctggtatactagtttaggcaaaaaaaaatgtcaactataccaatacaaaaataaaatctcggtaaagtataggaaactagcatgtaccatttgtctagttgaataaaatatagtttcagtacaattcattaataaaactttagggtgtagattaagaacaaatgattttatcattacttctttttagcacctacctagatcatcacagcaacacttgcactgcatcattcaacaagaaatgactactgtgcatgatgcactacctatatatatatgagtcaacctcaattgaactcaaagggagttagatccatggagagaaagagaaaagaaatgatctattactctgaaattacctaaaaattcagtagcagcacacgtcatcgaggtggccgaagaggcagagactaccgatgatgccaatgaagtggatgatgatggccccgacggcgacttggatgggcgggcaacggtgtcctagatcgacggacggtggcaccctagatggagggtcggcaacgccctagatggacagtcgatggcaacctggttagaggtcggtggcgctatggatgtcgggccgacagtgacctagatggagctgacaacggagctggtgcgaggaggggaaggtgacgtggctcctctcgacctagcgggcgacgaacgaaagagggcgatttgtttcggggaaatagctgtcgcggttggggaaagcatggggagggaaagaaaaattggcgcgaccacacacgatttctgcgattgggagcgcgtcaagttgcccaacatctagttatgattggtgctggttttgggtgtgcgtaaattttaggagccatgtttagagcatcaccaacagttcccccatactcttcccaatatcaaaatttcggtcttttgtgtaaaatttgacctccaacaggatccctactcttcctcccaaaaattgacattcccttctccgcatatctcgttctccacaaatcgggcatccctctccctcccaatttcctccaccgtcgcgatttggtgcgcgctaggggaatcctgcccgtcagaaggtcctcggcgaggtcgtccaccaccgcattgacctgtccagcagccgcaggtgaccccaactccctcgccaacgaccggaaacgtgatgctattcccaagcagccggtggctccatcttccacgcagctggctagacattcgccggtcccgtccatcgccgtaggtgaccccaactcccgcctgctttccatgtcggcttggcacctccctgtcccgtccatcgccgttgtttagagaactgctggcggcggcagcagcggactctcggagtagcctaggagtcggttcccatcgaccacacctaggggcgatctgttgtagctgggtctactgatcgatgttgctgtgctggtgctaatgttgatctgctggcctgccgctgctgcttgttgcttctgctactgtgttgaactgatgctgatcctagaagtagccattgctcgtaatggctggctggctgctgcttactggttatgttggtttgcttgctgctttattggactgagataattttctactaaaatgttgttggtgtgatcgcattgaaatacggatgttgtactaatctaatggttgatgttgtactgagatgttttcttacaagtacaaatttagatggtagtttacaaacattgcaggacaaaatatgtagaagtacagtcgtggcgggggagagcaacgttgtgggatgggaggtgaatgcaatcgtgctgacagcaagtgtcgaggctgatcatgatcactgcgggaggaggaaggaaacatatttctgattgtagttttatagggtctacttttcagtcttagagaattaattataggtcatctcttggagagatgattattttcacaccttaaatttcttttaggattctgaaaaaccaaattttgggatgctgttggtgatgctcttataagtctattggaggcctggttttgatcaaattctcaaaatttatgtttttaggaacctattttggagatgctaccttctgcagccaacagatacgtagacgcagtcgttccggtgtgaccaagccgtaacggtaacattatgcgtccgcctttggtccggtgtgacactgtgaccccgccgtaaccccgtaacggtaatattatgcgaccgccaggtggggggccaaaggtcgttccggtgcgacccaaacccggtggagagtcccacacgccaaagccgcagcagcagccgcaacttgcggcggttccaacttccaagcaagcaaagcaacccaccccctccgccgcc

SEQ ID NO: 108997 - DNA, 908 bp, Oryza sativa
tccccttgtttcccgggcccggcactctctccctcgctcttccccacgccgctcccgcgcgccgccacactccggcgaactccggccgccgtttcccgtcactagggtcgccgccgccctgctccgccgccaccgccagctttgccgccgcccgggcaagctcggccaccgctccatttcccctctccacctccgtagcgccgtagccacgcgaaccacctctctccgctgccgcccccgactccagccgcgtcgcgccgccgcttcggtcgacgccgaccagcgccgttgcctccctcagctccgcaaggacgaggaggacctcggccgccgcccctcttcgccggaaatccgccggagctcctccttcctcggtcgccgatcgaggccgagcccgtccgccccatcccgagcgacgcccgtcgccggagctccgtcacgtcgtcttcctgaggagccccgtcgccaccgttccttgccgtcggccgcccctttgccgtcgtgcatctcggtgagcactcccctccctctcccttttcctccccttcgtcggccgcctcccgggcgtcctcgcgacgcgctgccgccgccggtggccgtccgaccgggtcgacttgcaaaattcatctaaaattgagctctacatgtttgtttactttttatgtactgtttgcttggtttttataagagtttttcctcgttttgcgtgccagcgtgtagttcccgtcgtttcggaagatcgcggtcgcaaggataagagttcggaagattgtttgaagaagcaaggcaagtcacacattccccttgagcatgttgatcctaatttacaaatcttttactgtttgcaaataaatatgcatgttttgctaattacacgggatcagggtttacctatctgctcgcttgtg

SEQ ID NO: 108998 - DNA, 600 bp, Oryza sativa
gcgttcttgaccgtgccacatcatccaaaaccacccttaaactgtcttaggagtcaatctataccggttttatcaatttagggagtcgttttatccggttttgtcattgagggatatgaatcagatccagtctatatttaagagagtcaaagtggacctattcctttaaaaaaggaaaaggagataggctaagctcgaatggaaattactgtatgcccaaaaatggaaatttggctgatcgcgtaagcgagtggcacgctaccgctcgcgcaatggtcttctcggtagacaacagccaatagcttggcagggattttgtgttagattcctctgcttggatatgcgaacttctgggccgaatttacctacatatttgggtcaaacattcaatcaattttgggccacatttacgagtaactttgggccaaaattacatgcacatatgggcaggatgacagctgcaaaacgtatggatgaattccatgcatcaaactattgactatgagaggcaacaagtccctctcaaaaagagagagagagagaggaaacaagtaatttactttaatttattttgtttagatagataatagatattttatt

SEQ ID NO: 108999 - DNA, 746 bp, Oryza sativa
ttttatatgttagctgttaatttttcttttcaatctgtaatttttctgattttttatgttttttatttcgatcttctttcagatggatagtacttacgtattttctctcgtatagaaatgtatattagaagtgagagattatattttaatggatctaataataatctaatggtccaaaataacgaatccagagtttaagtattagatgttttacctttttcttagaattctctaattttttatcgcatcacatgacgatgtatgagcgttcgtagaaagccacataatggcttaagagtgtttgtaggaaatttaatggacttttagtaccggctaggagggaagggtgaaggagatttattttttatctaatggttaatattatcgggtccaccattttaaatgaaaactgatggttatatattttttttcagaatttttctctaatttattagaataccatgtgatggataagttttttattttttcgtatagtagatctaatttatttatgcatgttttgtgaaatgatacattatcatgtttttctattttatataataattttaatagcatggatatgataaaaactaaatatttcttacaagttaaattacagattatattgccttttgaatcgttaatggaccacaatggatagaataatacggaagaataaaaagttttatgtgtaattaaaaattaaccacattttttataaattatggttattttaaatttattaa

SEQ ID NO: 109000 - DNA, 793 bp, Oryza sativa
caatgggccccgaaacccggaacccgacgggtaattactctattaggggctgtttgtggttcagtttttgtccccatgggtctcttagcgggcaaaagtgtcacccgtcgggtggagcgggtgcaggtccgttatcttgcccccgtacccgttaacccatggggctgatatgcagttcttgtttaataggtggcccatcagaatttcgtttcacatgcattgtttggcccaaggcccatgcggagaagagctctccagtaaaaatcaacgcaaccctaatctcattcctaagtcctgaccagccgcctcccttcctcgtttctcctctttcctctctcatctcgctgtagtccacacgcggacatgccgccgccgcctctgcactgcgccgcctgcctgcctgccgcgaccccattttgtccgccatccgtgctgcacctgcgcctcgatgccagccaatagatcgacgaccggcggccccaggcgcactgcgtgctcgaccacgccgcttcctcttgttctgcgctgctcggcttgctgtcgtggttgttgctgttggggtttgaaaacccgttggttccccggaaccgtttccgggaacgggaacgggaacggggaaattcaccattcttgtccgggaatgggaaggttgccgttcaattttttttcttccgggggtgggcacgggttgttgccacccaacgggcccagcccggttcccatccctacccataaccaatggccacatcgtccaggtgcgctacggtgacacaggtgcgggattgggaggagg

SEQ ID NO: 109001 - DNA, 514 bp, Oryza sativa
cgtcagagccatcaaaacgaggcaaatccatcttacgcaaacaactcttggctcgcagcccccttcatgggaagggggcgactcgattcagtgccatcccaatgcggagcagatttcagaaatacaagaagtggaggcggcggtggaggtggtgaagcacccaaactagccatggagagagaggacggggaacccagagtactcacttggtcacccaaggcatgcttctgaagacgcgcagcctgcgcatgctcctgctgcaatttccccacagattccaaagcgagatttactttggtggccacctgatcaatccagccgccgtgcttttccatctttctcatcaatagcctccatcctctgagtgatggactccagtttctccaagagctccattgagtccagcgactgctgcaatggagcactgagtttgatgggcgccgggtgccttctccaaatcccaccgaaacagaaccgaacttacagcggccgcacgcaagggtagccaccaacc

SEQ ID NO: 109002 - DNA, 801 bp, Oryza sativa
ccgactagaaaataacttgtctttgcttatatgtaaaaaaatatatttaactacagtagcaaggaaattccatttattactatataatatgtctgttttaattgcatctgtagatagaaggacgtgttatggggattggtcatccagagtatgcaagcacaatgtaccttcttggcaaggtactgttgctccttttatatttatattgctgctgtatatcgtgctctacattatagactcattaccttttgtcagtaatcttgcttgtgttaccttagtcctgttcctttcaatcagggtggtactagcagtattttgctgtttaagctattgttgtagtgtttttatattttcattattttgtgactgcaatcctgcggcatattgcctttccaaacctgcacattccagctgaggatacttctgttttgctgtttaacctatagatataactttttacttttttttttcttgtcaatgtatcagctcacattatcttcctttcttttgctacatttttctgtaagtaatcattgccttttgtcgagaaccaatcagactcctagtgaagacctgaattgtactccctccgtccaggaatatgggggattattcccaatctagcacaaattaaggaagatgaaagattgcatctaagacatccagcaatacacatcggcacattgaatgaactgcacaatgtacacctttggggattaaactattaaactttggcaggttgaatggtgtggagtagcactagtacattctctgtatttcttttattctgacgggaactgg

SEQ ID NO: 109003 - DNA, 661 bp, Oryza sativa
aaaaatcgaacgccaccctccccatccccgcacacgagtgtagatttcccccgtccccgtccccgtccccgcaacgggtacggggcacccaccgggtctccacacacaacagcaacaaccacgacagcaagccgagcagcgcagaacaagaggaagcggcgtggtcgagcacgcagtgcgcctggggccgccggtcgtcgatctattggctggcatcgaggcgcaggtgcagcacggatggcggacaaaatggggtcgcggcaggcaggcaggcggcgcagtgcagaggcggcggcggcatgtccgcgtgtggactacagcgagatgagagaggaaagaggagaaacgaggaagggaggcggctggtcaggacttaggaatgagattagggttgcgttgatttttactggagagctcttctccgcatgggccttgggccaaacaatgcatgtgaaacgaaattctgatgggccacctattaaacaagaactgcatatcagccccatgggttaacgggtacgggggcaagataacggacctgcacccgctccacccgacgggtgacacttttgcccgctaagagacccatggggacaaaaactgaaccacaaacagcccctaatagagtaattacccgtcgggttccgggtttcggggccca

SEQ ID NO: 109004 - DNA, 3694 bp, Oryza sativa
agtctttgaatcccacacaaagaactgcccttcttccgcgttgctgtcctcatttaccatatctcatgttgggtttcgcttgtatcatatttgctaatggtttcttggtgaggtagccagcggccagcggaggcaatgagccgatgagggaggcagctaagcgaagaatgaatgtgttcagatgctgctcgatgcgaaaatggaggtatgatctatagattcagcagtgatttttttatgcccgacttatcatctgatcatggattagtgaattgcatcattggtacttcatgaaagaaattgtcgaggaagacttgggagtgtggtaggttgcagggaagaaccgcatgttggtgaatgagcttgaagcgttgaatgtgtattgtttttgcatccaacctgaaagatgcagatttttgcctctgataagtggaatgcatttagttgtttttttgtccattggatcgacatatatgaacattcagcagtaagaggtccttaagatggccacttgatgacatggaaaccctgttggtgcgatcaacgttttgacgagatctgttgctcttcggaaaagagaactttttgaattaatttgcttatccgaaagaagtgtgttcatggttaatatgcatacctttgagcacaaatgacttatgttaagggttgattaaccacttttgtacttttttttgggaggaatcatttatctacttgttacactggtaatacttgaccattaactgaaaacatgcaatctgctttagcatccacttctgaattttatatgtgaatggatgcagaactctgctttagctaaccatatgattcggatttttcttaaatgatactgctgaatgtgatttggtacaatgggatgaggcatctaattgtattgcttcaaatggaatggtgttttagataaacctcagtatatttatttttaggcaatagcgtggaatcatgctggaattcagaataaaaagcattaggtccatcctggagtttagaataaaaaccctctctctcaatattgtttctcatatgatggcaagtagaataaaaacctcctctcccaatattgtatctcatatgctggagtttatattaaaagccttagctccatagcttctggtcgtcatttctgttcacctgttaagatatcagggttcagacttcaacatggtttcattgttctaggtctttcaggctatttaatcaataaagtatgtctatgatcagattaaattgttatattttactgtgattagctgtccttttccttcatctgaatgttttgaggtacttttaagtttcataatctaaaaatgttttgcggttcacatcatagtagccttcactaaatgtgaactgccagaatgttgcatactaaataattacactgattgttccccctgctgaaactagatgagcattatctgaatgttgcctttttatgtgtgatgtttctccaaaactgaatgtgaatccattatcgcggaattatgtcagtcccattttacaaagcttagatttaatatgatccagactgaaactcgattcacctcagttgcaaattattatgagttttattgtatacatccaaatgaaaaattagtctcttcgttccagtttgctgtcctgcaatacacggcgcacatttggactaacaactcttttcatatttgtgcagtttgaggtggtgatcttttctcctgaagataaaaattaagttttttacgtaaaacgaggtggtattaacatatgattgattgagtttaaattattacaaacttgaaaaatagattaatatgatattttagagcaactttcatatagaaagtttccgcacgaaacgcaccgtttagcagtttgaaaagcgtgccacgaaaaattttaatcttcatccaactttcatttgggggatactgatttttattattggcctttatttattgttcatgcaagcactgcgtataagaggaagccataatgcggttattactagcagaaatggtaatgcatgctcaactaacaccgttcaaattattccatcaattttaggtgcatagaaagcaattcaatcctgataaacatcacggtattcatctggttgtttacatgcgcagcaaggacttaagggatcgtttatgtatcatcgatctgcgatgtaataatatagattatttaccatgtcattcggttgcttaataaaaatctgtgtatgtaattatcacaggagatatagtagtgaatgatcaacaatgtacttgttctcatagtaactttgggttgttattgtctctaacacagaagatcattttgccaataataactgcattgtgtatgcttgatttccttacatggccaccctgtatccagattaatcaggtattcttcacttgatgttaaatattggttaccattaattattttctgttatccagatgcaaatacaagtcccagagttatctgccatgaggggttaagaataaagtgaaaaatgttgcttacatgatgtcctcatgattttggtatattttaaattaactgtaatccaccactaacatgctttgtatgtctcatttcaccctatctacgacacttgaattagaatcatgcgctcgtcatggatggcgggtcagagtaaagcaaatcgatcaattgatataatagatctataagcagtttgctttttattcgttatttcctagcataactacttttgtatttttatattagtattttgttgttccctaatatcgaaaattcggatcgggcgctctcctcgcgcgctcaccccccccccctcccaggtgctgcatgcaggccctggctccaccacgtctcggctcctatctgtcattgcaacaaatcactaacgtattttggaaaccctttattaagggaatttggttttttttccaccaaaaatgtttcatctaatgtactcgcaatgtttcactatatatagatctaatgttgcaatgttgcagtgaactgaaatattccattgcaacaaaaaaacccacatattttggaaactccctattaagggaattcgtttcattttttgttccaccgaaaaatgtttcacctagtatacttataatgtttcactatgtatggatcaaatattgcagtgaactgaaacattctttcgttttttgatgaaacattatttttatatgaggtgaaacaacacccgatttaaacgagtgaaacattttcgatctacttagtgaaacaattccgatatacctgatggaacatcgtgcaacatttaaaaataattcaataataacttgaaaaaaattcgtcggaatatatccatgtgtggtcttgttttgaagatttaattgcaacgaatttaatggtgcaatcggatcatgatttggataagtaatttaagagaaaaatcagtttaaagtagttttgtacgtaaatcggacgttgacgtcatgtatttttctccaaaccgactgggcgcccgatccgtggactcgtccccctaatatgtatcaaaaattttggtaaacgatttctgtagtgactagctatatataagtacatggtaaaagttattaagtttgtgatataaggattattgcctattttgcttgcaatggaagtggaaacaaatggttgaatatatcttgcacaagtccatttgcaatgccactatgccagttca

SEQ ID NO: 109005 - DNA, 1972 bp, Oryza sativa
cctgtttgttatagctccaactcctaaatttaactttaggagttgggtttagagtggagttgtgaagctgtctaaatttcattttgtgagagagctccatccagctccactcccagttttggtggagctgaatctgtttggctgagctccacgagtggagctgtgccaaacaggcctataacttaatctaatacttccttctcccaaaatataactacctagtacgggatgtggcattacctagtacagtcctgtccaaattcatagtactaggtaatgtcatatactgtactaggtaactacattttgggacagatgaagtattgaattatatcctatctaatactccctccatctacctttgatagtcatatttcatcttggcacacagatcaatgataagtaattctacttatcatccatttaaacatgctactagtcattcctcgtaaacaagcgattcattaatatttacatttcacgatgctcaagtagccaatcttgtgtggaagaatggagagttatgcattaaatccgagaaagtcattaagatgataggttgttgaattgaaatatgcctatcaaaaatagaattttcagatttgaaaatataactatcaaaaatagatggagggagtattaggtcaggtttctatggaactgagagattacgttttaatttattatcgttcccacaaatcttatataaaagattttctctaacaaagaactctaggagaaattcaatcctatcaaaattcctattaaaatatagaaatttgcaggagttctaacatgaacttaaacctcttaaaataaatcattcgtgtatatctttcttctctgattcctgcgttttcccgcgctcggtcattcctattgtttacaagcatttttcaatccataggatttgagtttctatgccactttaatcgtgcatttttcatgtttcctgtatgtttgagaatcatgcattccaaaggaggcctaaattagtcttaggttgtgttcgacagctgaggatttctctcattctcctcgtgcaggcatcctgaactactaaatggtgtggtgtttttgccaaaaaaatctataggaaagttgctttaaaaaatcatattaatccttttttcaaatttaaaatagttaatactcaattaattatgtgttaatggctcacctcattttacgtatcttctcaatcttctcttttcctcttctctcaaatgcagaccccctttgatttgaatgaaaaacataagaattttgtagaattttaattctacatgattttttttctatatagcccttttcaaaggattgaaaagtatattaaatactactacatccatctcagaatatagcaacctagaactgaatgagacatatcctagatgtatcgtagtactacgattttggatagccctctatcatcagtatgaaattcctaaggaatcctcaatccatacaagttttataggatttttaacctagaggtccaaccacatgaaaagttcccttttagtcattctccctcatctaattcttgtgtttttttatcacagttgaattaaacgattatttctatattttttacgtgtttataatcatatattttacacttgtatttttgcccaaattctatggttttttctcttcccccgttttatcaatcttgtgtttcaaaggagctaaaagtggtgtgataaaatacattgttatactcatctatctaccctatagttcaccaattgtgtcttacattcatcatttatcattgatcggtcaggatcatctcactcatatccaacgcccctcgtcgctcccacctcccttctctctgccacaaccccccccaccttggatcgcgatctcctctgtgtctctctcccatcgctcccctctctcccatgtgtcttacattcctcattactcattgatcagtcatgattgtctcagggctgcaggaatt

SEQ ID NO: 109006 - DNA, 1685 bp, Oryza sativa
acccagccaaaggtcagttttcgtttgatggactgatcatgatttaagcaattaatcacacacttggtcagtctcaaccaaaacaattaatcaaattgggttgtccacttgattttatgggaccgttcattggtataaaagtgatctcatccccagacaacaaccaacaaccaccccccccccacccctaccacaaacacccccaattgtccacggtcgaactaatcctcccaatcatctgaaggtataataatatctgaagttatgtatgggcattaggaaagtattttcttcaaccatccttccacattcaatcatacctcatttaaaaaattttcttctcgactttaatatttactaaattatttgaaaacatttatattatagaatagacagagtattctatctatcatacttatgccaataataaagtgggcatgccatactctaatatctatctattatattattaaaggaatagaaaaaggagcctccacgtttgctttcaaggcctagaaattctcacattaatcggagaaaaagaaaaaacagagtacatatagaaatacaatttagaaatagttaaaattcggaattaaaactaaggaatattggaagaggagactggagtccatatagaaatacaattaggaaataactgaaatttggaattaaaaataaggaatattaaaagtagagtatagagtctatatagaaatacaattaggaaataataaaaatttgaaattaaaaataaggaatattagaagtagagtataaagtccatatagaaatacaattaagaaaaaaaaaagaaattcggaattaaaaaataaggaatattagaagtagagcatagagtccatataggaatttaaaactaactaaaatttggaataaacataataaaattaaaagtagagtttagagtccgtataaaaatataatttacaaataactaaaactcgaaattaagaaaaacatgggaagaagagtttaaagtcaatatagaaatacaatttagaagtaactgaaattcaaagttaaaaattagtttagagtccacatagaaatacaattagaaataataaaaattcagaaataaaaataaataatattggaagaagagcatagagtctatatagaaatacaatttacagaaaatttggaattaaaaaaaagaaatattaaaaaacaagtcaatatatataatttacaaataactaaaatttgatattaaaaataattaataactaacacgtatataaaatacaatattaatattacacattagtagttttgtaaagttattgcaaaatttaaaattatgttatcattttaatatatttgaataatataatgagaaaacatactatatgatattatatgagagaaaatataatgatgctagccgcgcaaaaaatatactatatgctattatatgagagaaaatataatgataatagccgcgcaatctgcgcggaccaccatgctagttctctcttaatttaggtgtgttcttaactcttaagtcatggtttccaactttatccctttgttttccgcgcgcacaaacaaagggataaagttgctcaactcttaagtcattgctcaactttatcccttcgagatccaaagagtaaaaaccatccatcgaacaagtaacaatgagctctgcacagagg

SEQ ID NO: 109007 - DNA, 1405 bp, Oryza sativa
actcgccttgctttattaatctctttcacaaaaatattttcatattcaccaatcgtgattagagttaaaccataacaaattgcttccatatgcatctctagtccagagtgcagttaacggacagactttcaatagctagtcagctagaagctatgctgcatcactccaggagaaaatggtgtttatccacaaaattttgtaattgagtgatttcaaaattagacaattcatcatagctcccgtccataccaactcacatcaatccaaattgagcatgcaaaagcacaaactaaagtacactacagcatataaaaatagatcattgaagggacaagaatcaaattttgtgtctgtctgtctgtctgtcgaaaagtgatcgagaatagacaagtctcccagtctaccatacaacttggaactgcatatatatcaagttcgaatccaaattatagctagtgaagcaacaataataatgtgataagaaagtgatctagctagctgcatacaacttccaacctccagcaaggacagaagaaatatgtagccctcttttcagttttgtcaagattgaatgctacatagtacaagatgatttaggcttttgtaaaaagtgtattattttcttgtgttagttcatgatagcttgtcaggtttctaatttgcatctgtcagtaattcaattcatgacgatgtctgaaaatgaattattcatctttagcttgatctcacctatagtctccaggtagcaccgtaggctgctgctcctctgtgcccgcccaacagtggaaccatgacgatatgttcgggtcaccttttggttttagtggtagtttgcatgttgttctggaactgaatttggcaagtgcgttactttggtcagatatatgaacctgaaacgtgtttctaatttggtcagatatatgaacctgaaaatgcacatatgaaaaatatgattgaatggtggtgagcagtggaggacttcttagacacggcatcgtaaggcatgaagcaaatggatgcatggctgcagttggcagattcatcacttctccggcaagcacataactggctaagaagaaagatcacctgaaatgacaaacactaaatcagactatactcaaagaaagaaatcatttagtgcaccaactacatgttatgcaattttgcctgtcttgattctaaccagaaataaatcattatgcaattgccataacggagtgctcttaatgggcctgtgatgtaagcgaaatatttgctactcgggattgattattcattcaaacctaaggtccatattaccactaaacacaacaaataatctgcatctttgatgatcaataccacgattatgtgaacaccaaccaactttgatgacggcaagttatggtggtggggctgcaggaat

SEQ ID NO: 109008 - DNA, 707 bp, Oryza sativa
aaactgctttaagtttaactaactttatatgaaaaatagtaatattttcgaccaaagataaatttattataaaaatatatttaattattaatttaataaaactaatttggtaatataaatattactatatttgtctgtaaacttagttaaatttgaaggagtttgactttgaccaaaatcaaaacatcttgtaacctgaaacggaaggagtaattaagttcatttccaggtgaatataattcgtatccgtaaactgtccaaatcaagcatccacacaccaattttatccctttgatgatctgaaagtggcgaagcatattttagggcgccccaaataaactgatatcatcacgctgcatgaagccatgaatcatgtgtggcatactagtatccacctgtgctgtatcgtatgcacaaataaagaaacaatatatacacttaactatcactcaattaaattgatcaaataactccgaagtaaaaaaaaaaggttaaatcagtacaggaaagcaatcgattaatagctcgatgctgatcacacgaaccatatatacctacaaatcaacaacaaaccagctgaagatacattgagaaagttcaactaatttgtggccgtacacaaatagagctctaattaattaaacttacttggctatgaatatcctttttcttctaataattaatcttatatccaccacacattattc

SEQ ID NO: 109009 - DNA, 723 bp, Oryza sativa
atcctttttgacaaagcaataattgcattcattatattacacaagtcataaaaaggttgtgtaaagttctccattaccaaattaaaatgtaggcaatgacacaaagctaagcccatactttctttcttctcgtaacataaaaaggggaaacacagctattgatctaatccacattctttacagtatattccatagctaggaatttctaaaaacaaaaaaagaaaagtattttctggtaaattttggcttttggcctttgagtcttaaaagtcgatttttcaccggccctaaaatgatacctattgttttcaccatcgactttaaaacccaaacaaataacgcattatagtactagctagaccctattgacatgcattgcttcttcttcttcttctttttgacatgatggtagtttttgctagtgcaaattcctactatatatgttttcttgacgtggatgtcacttagttaggtttacatcaacataacttacctataataggagttcgtgttaccaaaaactatcgtcatatcaatcaaaaccaccatgaaacaagttttgaggtgttatttgcctggttttgaaagttaaccgtgagcaataattggcttttatgtataagggataattggactccaagaggagttgagagccaaaagttgactttacccttttcttttgacaatcatgagcggttatttctaaatagggctgcaggaatt

SEQ ID NO: 109010 - DNA, 610 bp, Oryza sativa
tttccaaatgcgaatgaatttaaaaaccgactcaaatacggatgacataccaaaataccggtaaaaacatcttcaatttttataatagtagagatttagattagatttattattgagtgagagtattcttataatgttcttcaatcaaccctttaccttataattgattaactcctatatagactttgatctatataagtgtgatgtgaattaataacattgtaatctaggtgaaatgctacatcagtatatccgtacacttgcggattatatatgtaaccgttagaaataccgactaatatttctggtaccattgctggggataatgttcgtagtaatgttgttaagaaatatcaacagtcgacacggtgctctatgggtaggctgctccagtcaggtcctgatcctaatcacctgcgagctccactaattcaatctctattctcctttcactatttggtatttggccctgtttaggttttaacttttttctttaaactttcaacttttccatcacatcgaactttcctacatacacaaacttccaacttttctgtcacattgttccaatttcttcaaatttccaactttaacgtggaactaaacacag

SEQ ID NO: 109011 - DNA, 596 bp, Oryza sativa
gcgtaattaggctcaaaatatttatcttgcaaattaatcgcaatatgtgcaattagttattttttagcctatatttaatacttaatgcaggggttcaaacgttcgatgtgacggggtgtaaaagttttttttacgttggatctaaaatttttagtggtagtcttcaattcaaaacacgtccaatcacaagaacagtttaaccatcacatcgaaggtacagaacacaaacatcgacggatccaaactcatcaacctgaccccgaatcccactgccacacgggccccaaatcccacggcccacatccccccacccacaccacaggccgcggatacttcactggattcccaatccgacccaacccaactggcacgccaggcacaccaagtaccccaccaccaaccagggccccacactcccaaactcctcccacccgcacgccgccgttgccacagaagatccacgcccagttctacgccacctatgaacacgcgcgcacacacgccgcgcacatacatgatcaaatctcattcgctcgccaacgccgcaagatcgagcgaaccccagcgaatccgagcgcccacgcagccacatccca

SEQ ID NO: 109012 - DNA, 543 bp, Oryza sativa
tgcatcaattctactataatttaatatcacaatgcacaggagtaaagagttcaaaatttcaaaactgaaaattgaaaaaaagtaaaaaaaatagaaaacctatttttttttttggcttggtgcaggactgcatcactgcgggcgggcgttggcggcacacgctgcaggtctgcagcagtgcgctagtgcggcactgcggctgcagctgcggcggcagccggccaaggtgtcgacgcgcgcgcgtggcccggtggcgctcgctctcacgatctgatcagatcgctgatcgcgtcggcgtcgcgactcgcgagggcgaggaggagagatacagagagtcctgtgacggcgcgacgcttcggtttcttaattccgatcgattagatacaccatacacgcgcgtgtagggtggggcctgtggtaatctaatggtttaaaatattaggtacaccaatttaagtgaaaatcgacggttagatttgatagagctacgtggcagcctaagaacgtttgtaggagtcccacgtggcagcttgagtgcgtttg

SEQ ID NO: 109013 - DNA, 572 bp, Oryza sativa
cagacatctatatttccaaacctctaataggggtgacattcctggctaccttaccataatttagaactaagaatgaggttatgcccaggtgttacagttctcaacatgaggcttgtgaactgctgcatgtgttgttgacattctgctaccaaaaacgattagttctcttaacaaaataaaagaaaaaaaagggtaccatggttgcttaggttggatttttttaatatactgagacaaatgagtgttatttctttcattacacaacttacctggacatgcgcaggagacattagatcttcattagcaggtggcactacatcttcctcagatggtggttccactcctgtcttttcataaagaaactaaaatgggacagggattagacaaggctagaatgcagaatcacatattattgtacagttatattagaagggtttaccctgatcagccggttcattggaatccattcggcggcgaagttctgcattttcgcgtgtgagttttaaattttcgtttcgcaaagtttgattggctgatggggtagatggcctaggtgctgtctctttaccggg

SEQ ID NO: 109014 - DNA, 648 bp, Oryza sativa
tcagcaaagtacaaggaaatatccatatgcacggctgacaaagaaaggctaaagctattttgcataacatagctgttgcagttataaataatgggtgttaccattcgactgcccacacgggacctgtccacataagaccacacagctatattcattaacctgcacaaaagtcattctcattcaatgttttcgcaaactacctctcatgagatatcaccgagcatgtccatgaccgcggatgcggttattcgaatagattagtttaacactctacagaggttgtacagcttacccacaagatacatcatctttttgacggccagttcgacaatgtcaaactttagattgtgtgcggccaaggagtctagaacaaggctttttagaaactccaccgcaacactgccttacccaatgaaacacattccctcacataaaggagaaagtacccatggctaaccttaacacctatcgtctagccacctgggtgccaagactcggaatcctactaggccaagtccttcccatcaggacatgtggttgcacgataggcttagatcaacggcttatgaagtgaagtccttaattgaccaagtcaacttgctaaactataatagcacacatctcaacagtaggctcacatagagacca

SEQ ID NO: 109015 - DNA, 722 bp, Oryza sativa
acgggcatggtctctatgtgagcctactgttgagatgtgtgctattatagtttagcaagttgacttggtcaattaaggacttcacttcataagccgttgatctaagcctatcgtgcaaccacatgtcctgatgggaaggacttggcctagtaggattccgagtcttggcacccaggtggctagacgataggtgttaaggttagccatgggtactttctcctttatgtgagggaatgtgtttcattgggtaaggcagtgttgcggtggagtttctaaaaagccttgttctagactccttggccgcacacaatctaaagtttgacattgtcgaactggccgtcaaaaagatgatgtatcttgtgggtaagctgtacaacctctgtagagtgttaaactaatctattcgaataaccgcatccgcggtcatggacatgctcggtgatatctcatgagaggtctatcttaaaaccttaaataacatgttgcattggatgaatgaattcttttattcaaattctacttactactcagtactctctccgtctatcccaaaatactataagagattttgatatgacgtgacacatccaacaaatctagacatacttatgtaaaaatttctataataggatatgtcgcatcctactaaaattccttatatttagggacggaaggagtacttctgtttcaaatgaattcattttatattaaccagcgtcata

SEQ ID NO: 109016 - DNA, 591 bp, Oryza sativa
aaaacacaatccataacctgaactaattcgcgagacgaatatattgagcataatttatccatgattagtccatgtgataccacagtaaacatgtgctaattatgaattaattaggcttaaaaaaattatctcacgaattagctcttatttatgcaattagttttattattagtttatatttaatcttttaaattagtattcaaacatctgatatgacaggatcagtccctgtatccaaacaccacctatgacatgtaaaaaaatcagctcaaaatacaacatatacacatagaaaaaatgacaaatctcagtggaatagaaaactgatttgtttaaatactattggagaacaaaattgtttctttttctcattgtgcacattgtattttgagttgatgttttgtgtgatggcaaatgtcataagtgtttcacatctcgaattttttttcatattgtttttgacttttttgatgtattttttttaggttgcgtatatgtagcacgctactgtgcggtagtacctgatattctccacgtgggtgtgacttcttgggtgcttgcagcaagctttgtggcttttcctcatatttt

SEQ ID NO: 109017 - DNA, 1307 bp, Oryza sativa
cttataacgtttaaattgtcaccttgttaatatttcataaagccaaaatagggttgagtttggcaacaaattgatcagctcctaattaccattccgtataaccttacatttgatgtgcagcgtcagatatgcaaatggtaagtattactacctccttttcataatataaatatacttttgtggtttttaaatatatttggacatttcattaaaaatgcatagaaatatttgtactatttttttcttttcagattggtagtatgggatagctatattttaaaattattaggggaatatttggggacgaagtttcagaactagtagcatgcaattaataaactttttgaaattgtgcaaatgcagaagtcacatgtacctgctgcattcgtctgtcaagtagagaaggatgagaggctgaaacaacagcgccgacgtgtcgtctctaattaccactcgtaaattttaccgatctgatgatgcggaagtgctaatcggggatcgatcgcttgggcacagggctagcgatcaatccccctccctcctaaacctgattttcttttttggcaccacattacttttctattttagtaaatttatgcacctaaaatttatacacctcaagtttatacatctaaaatttagagaccaaaagtttatatatccgattcaaatttgaatttgaattcaaatattttttttatatatagtatttctatacatctaaagtttatagatccaaagtttataagtcaaaagtttacatgcccgattcaaatttgaatttgaattatatcgggattcaaatttgaatttgaattcaaatattttctatatatagtatttctatgcacctaaagtttatacacctaaagtttatagatccaaagtttataagtcaaaagtttacatacccgattcaaatttgaatttgaattatattcgttcaaatttgaatttgaattcaaatattttctatatatagtatttctatacatctaaagtttataaactttagtttatagacccaaagtttataagtcaaaagtttacatgcccgattcaaatttgaatttaaattcaaatattagtttatagacccaaagtttataggtaaaaagtttacatacctgtttcaaatttaaatttgaatttgaattcaaatattagtttatagacccaaagtttataagtaaaaagtttacatacccatttcaaatttgaattttaattcaaatttgtatagtgtagtagtaagagaagaaggggatgtaaagtagtaagggggaggggtgggtgatcgcttggga

SEQ ID NO: 109018 - DNA, 698 bp, Oryza sativa
tagtaaccaaaaacaagtggcttggtgaaccatcactggttgaaccatgttgctttccaaaacgtcacttatttgtgctcataggaagtagtgataagaaaattttaatcaaaagagatgatatagtttctcaaatgcagtgctatatttttcaaagttattttaggaagaggtaaactaaagaacatacctagcgcatgtacacacacacacacaatatatatatatatatatatatatatatatatatatatatatacgcacacgtgaaaacaaccctcttttaacacgctgaaaaaaaatgaaaaccagtgaaaattcatgttcttactaaattcctactcctactaactactccctttatccacaaatataactttttttatgtgacatatcctagtacagcgaactggacaaactctctatatgtgtcgcatccggacaaaagaccttatatttgtgcacatatggagtagtcactaccaccagatatctgtttcagctttggttttcaaactgctaataaaactagtactatcccataatataaggatttactgcttagaaaagtgctgcggagtataccattttttcccgtagatgactgctgattaaaaatctcaaataagtgtgttctaagatcatatataaaaggccatgtttagatcccctggaaaaatttttcaccatgtcacatc

SEQ ID NO: 109019 - DNA, 732 bp, Oryza sativa
gtttttttctttcatagttcaatgctactctctcgatttcacttacatgtctaaccatgtaaccgatgtaaaaaaagaaaagagagacgtataatatcagtaatcttttaggtacatgcagtaacagaggtagtaaagagggcaccaaccacatattaccatgaataagaaatacagtatagacacaaatacctacacacgaatcctacccgtatgagtaccttcgaaagaaggggctgccatatcttgagattgacaaataattagtcgtaaatgcaagcacccgtgtcaaatctatgaatgtacacacgcgcaccctacctgtatgagtacctccgaaagactaggctgtcatatcttgagattgacaaataattagcggtaaatgcgagcagccatgtcaaaattaggatttgaacccgggtgggccggttcctccacaaggaacttaaccaggtaatctacgctcacttcgcctgcatgctaatcttttaggtacatgtggtttgtcttctatgatatctgatttgattcttgttgtaagaacgcagataaggcaaattgaattgatcgaaatgctctcgttccactgatcaagtctgaagggtttggaagagcatggcactcctcaaatgttgttgtagttgtaccataaaaatggtcttacaaaattaaccatcaaacggccgtaacaaaaaaaaaaaccgaccacaagcaagatgaagtgaactt

SEQ ID NO: 109020 - DNA, 829 bp, Oryza sativa
ttagactcagtaattacatcaagatgatacaatcaaactgagtcactcccggcctctgcataaaatgcaccagccaaaaaaagaagaaagaaacaactagaacatctcccaagacaaaagtttaacagaaacaactagaacaaaagtttaaaaaagaaagaaacaactagaacatctcccccggtctctgcaagcatgcaaccaattagtatttagatgatttcctgggttctaataaaacatttaatttatctctttatttaagtcttgaatgtataaagactataaataggaacaacttatttggaaaaactcaaatgtgaaataggtgtaactttgatggatggagggagtattaaattacagtttcagtttgtagtgcaaattccgatggatagacctcaatcggtagtttgctacagccaaattaatgtgcagagagagttaatttatgtagtacttgtggtccagctaaaaatatatgtaagcgtcagatctcatcttaattatcatgccagctaatcttggaaatcgtacatgtatttttcttccgagagacatgatttggttcttgttataaaatgatcaagaaggatctttttattgattatagtgctcatgggaagctttttttcagtgattaagtctgaaggttctgaaacaggaagccactcaaatagtatcactgtatcataaaaaagggtcttcggttttaaaaatcatcaaaagggtcttggattaatggatcaaacgaaaccataaaacgatctcgagataaaaaaaaaaatctgaccaagccattctgattgcagtgcttgtcagcaggtac

SEQ ID NO: 109021 - DNA, 538 bp, Oryza sativa
atacatattgggggtgaatatacaatattccactatataataacttgctcactatatgccgacgatacacatgatttatgtaagaagagatcagtatcctccctccgtctcaaaatataagggattttaaatatgtgacacaactataaatctggacatgctccttgccaagttcgtcgtactaggatatgttccatccatccaaaatctcttatattttaaaacagatggtgtatattaatcgtacatgatagataatgatgtacaaattaagtccaagctgcttttgtgatcgcaacttcgcaagccgctccatctaaccatcatattagtatgtaccacctacattcagagctccatatatatagcacgcagtcataatggatcggaagcactataccaggatatatattctaagttgagtccagttgaaaatctcaaatcttcctgcttaattttgaggggaaaaaaaacataactgcattacaaaccacgagctgcatgcaagcaaagttgttcttcatgctcacaacaattt

SEQ ID NO: 109022 - DNA, 801 bp, Oryza sativa
gaggagacaataggggagactccggtctaacccctcctactcctctcctcctcctcgttccgtttttctacttcgcttcttgatccaagctatgcagatggagatctagggagagcaattggcgagagatgcgaacacaggaggagggaaaggaggcgccggccagggacaggggtggcggcaccatgaggggaggtgggattcggttcccctctctttaggttttaggggagaactaatggcctgggtttatggtccttctcatgttagcccacttctaaagatatttttcttttatttatttctgttaacatctttattttaacaagtcaacccaaactaaaaaaacctaaatatcttttaatatacggggtattacaacctctcacctactcacctatcactatttattagggatattttggttatttatctcttcccttatattcaccttgaaaagatagggttggactttttataggagagagagagtactggtagagtagcattagcataagaacttaatacacaagagaggcaggcaagccacgacccacaaaggtacacactaccaaatgatagccggtcaccgtatcatcataatctggtgggtgagctaagttagggcctgtttggatgcgtttggatgcagggactaaactgccacatcggatattgggacactattacaactattagccgtagataggggtgaaaacggttatggaaattcccgatcgaccgggcaccattttcgttttaggggtaccgtttccgaccgtaccgtttctggctattttt

SEQ ID NO: 109023 - DNA, 1109 bp, Oryza sativa
acacaaatgtgtaaattttgtgaacaatgttactaacactttgtcggataaagaaatgacaaaaataaaagatgtagatcttaatgagttatacgacttttttgttgatgacttttttagttaaatcatttagtatttgaaaatggtgtttcaagttgtcatatttacaggttcaaattcaaactgttcaaaaaatgttatatagaaaaatgaccaaaataaaagttatagatcttgatgagttatacaactttgttgttgatgactttttcagttgaaattatttagtatttgaaaagttgtttgaagttgttatatttacaaattcaaattcaatctattcaaacaaatgatatatagaaaaatgaccaaaataaaagttatagatcttgatgagttatacaactttgttattgatgactttttcagattgaaatcatttagtatttggaaatgttgtttgaagttgtcatattttcaaattcaaactattgaaaaaaagttatatagagaaatgaccaaactaaaagttgtaaatcttgataagttatacaactttgttgttgacaattgttccatttgaaatcatttagtatttgaaaatgttgtttgaaattgtcatattttaaaatttaaattcaaactgttaaaaaaaagttatatagaaaaagaccaaactaaaaagttgtaaatcttgataagttatacaactttgttgttgacaatttttccatttgaagtcatttactaccaaaaaaattattttgactcataaaataaattattatactgcagttaactatttcattacatgtcaacttacaaatataaacatttcatatggaaaatgaaaaaatattcatcggtggcgggcattagttaaagcccgatagagattatgtcatctcaatcgagcattagtacaatgcccgtcatgaataagtcttctgtgacgggcctagttattatctcaatcaggcctcaagttggtgtccgtcatggatgatggtcatccgtgacgggctccaacttgaggcccgattgagatatgaaatgttatctcaatcgggcctaaattactgccggtcactgataggtggcatgcgtga

SEQ ID NO: 109024 - DNA, 781 bp, Oryza sativa
ataaagaaccaaattgcactcccatgactacgcatggtacttgaataattgaaaccggaatcaaagaaccaaattgaaaccatattgcacatccatggcaagcatggaacttgaattatttaagtagaaccagaatctagaatattaaaacaagaataacatcgtacacataagattaacttgaaatctaaatggcgtgaacaataatatgaacataagcagttacttatcacgtagaaatatataagacataaatagatagagtaaacaatccatgaatcacacaattaattcgtcatgcacttgcctccaacgaaggattggtatcatgcacgatctgatggaccaccacctaatcacaaacaaaacctcagcaaacacatccaaacatgcgtataaaacaatgaaaaaggtgaacctactgccccatcccatcaaaactcaataacagagaacaccacttagactatacacaagactactgtttcaaacctttatatcttgaaatatgaaaaggctatgactgaaaatatatacattttgaaaatctacagaacaatacctacaactttgatgtagaaagcatatttttattctgccataaaaatggtctaatttgcgcttgaaagcaggcttcagaatctgtccagaatttcagactgtccacactaaacaaccataactggagttctagttgcccaatcagggtgtactttaccgatatggaaagctaagaaaaaactctacaactttgtctataggcggcctggctgattacatt

SEQ ID NO: 109025 - DNA, 591 bp, Oryza sativa
atccaattcacaccattcctttactggagttcgtgaagagattacccctttcacaaggggtggttacttctcacatactatattggagctcgtgctgcaactaactagtccatttttcttcactctccttcgttgttctatagctagcttattgctttttattgtacttgttctaaggctgcattcgacaaaggacaaacaaaggaaacatccatcatttttcacccgtatgtcagagtgtttttacataaaactatatgtagaaaagttactttttaaaataatcatatttctatttttcatgtttgaaacagtccttggctttttaaacagtcctaaatcacctgatgaagcgataatggcatacttctttttacgtgtcttatttttttcctctcctctcagacatagcctaagacatgtttggaactcaggaaaacaatatatatgaaagaaaacatttggaatataaaacgcataaatacatgtgtaaaacatataaatgaaaaacatacaaagtttaaaaagactgatgtttgaggattttttaagggatgatttaattacatccggctaatcctattttaaccc

SEQ ID NO: 109026 - DNA, 555 bp, Oryza sativa
cggtctttcgcgtgtgtatgggccgtatggcagcttagaagagaccttcgtctctctctcaaaaatgagagagtgtgcgtactggagttttacaaattactccgtactgtactacaatagactgaaatacaaagaagaaaaataattgagtattggttgacggacatactatcctactaatctactattcccttgcacgttcatgtgaggtctatttgcacacgggtttgttttgataatgctcatattttgaaactggcacagatccgtagattctaaactttgtgtatatattcaaactttaccatggatttcatagatattcaaattttgtacgcggttttttgagcgacaacagttgcagggtgttgactgactactgagtagggcatgctatgtacgtcgagtgtgaggagggggattgtccgtcgccaaaatatcacctcaactatgccgcgagaatgaagtcgcgctagttattttatactactcaactaaatcaaatgcctctctaatggtcatttagatgacgttttgtccaatactttaatttgg

SEQ ID NO: 109027 - DNA, 506 bp, Oryza sativa
tggtcatcatcgcccactccaagccgcaacgacctctccttgacccctccacagcctcaatgggagcctccacgacccatccagatcgatgcgccaccgaggagagggtagaggccgcgctgccgctcgtccttgttgcccatagccatgggcgccgacgaggagagagaaaggatttggcaccgacgaggagaggggtgaagggatttagcgccagagaggggaggagagaggggagatctggcgagcttcgggcttgttttggccgcccggcgctgtcgcttcatggggaccaccgctgcaaacaaccctccgcctggctcgccgtcaccgcttctgcctttcacgagagcatgtgggttggggaaaggggaagcatcggttttggggagagagacggaaaaaggcgagaaaaatattgttttttcatggaccccagttaaggctacatagcacggtgaaacttgtggctaacattattctttggtgttcttggacctacgtga

SEQ ID NO: 109028 - DNA, 638 bp, Oryza sativa
aatattaaggttttatgaacttaaactgtatatttaggttgtagataaatacattttaaaatttactagaaggagcataaactgtaattcaagaaatggatggcttactgaatcgtttttccttctttattattagccctctatggctctatagtatagacttccaagattgtttaggtagtacgatggatcagtttctcagcgaaatctgtctatctcaggtactctcgagatcttctgcacaagctaaaaatttcacgtctacttgaattcttcaaatttgtataaattttgtttgaactactttcaaatcagttaacatgtgtctgaccaacgagatgagtctgtttagtcctttttcttttctagattatgatataaacgtaggattgaaacgcaagaactaagccaaccgaaggaggggggggtttgaatggttggcatacccaaaaacccaaactttatgcggaattaaaagttaccctcaaattcgacggatcgcggtctgaccgaagtagttgcgtcggtctggccgcctggaagctgtcggtctaaccaagattggaactctggtcggaccgccgagatcacctgccgcgcctgaagttgccgccggtctgacagccgctgaccccccc

SEQ ID NO: 109029 - DNA, 595 bp, Oryza sativa
catatttgtccacatcacgagcttttcaacaccgtacaacaagtgtagtcgacgaatggctgatatcagtgtaaacaaaattactgttctcgatatttcggaacagaaagttgcgcttcagtttgaaaaatcgtttctcatggatgaaaattcagaaaatttagaaaacaatgttattttcaacctcatgctgagaggaggaaggaaggttttctttttctaatgaaaccatattttcccacttcatgtctggccatccccatataaaaaaactcataatgtgtcaagctttccaaatcagcacattataatcttgacaagttaatcgacccgttcagttgcgtgaacaatggttgtttcatgaggatgacataacgaggattcgaccctaacgatcacgttctatcacgtttaatttcatgacaataaaggatgaagcatatttgagtaatccatcaagttcatattttaatgttgagcttgtcagtcttaattgaatctagatattgttaccatgaagccggagccagcggatgtggtgtcgtgacttccccattttctccccaagtacaatgtaaaattatacaaaatcctt

SEQ ID NO: 109030 - DNA, 758 bp, Oryza sativa
atgaaattgaattgtttaactgtattataacgaatttcctttaatttaaatgaaatacatccatgcaaacaaagtcatcctttaaatctaaattccaaaaataaatgtcaattgattcgctagacttcttctgtattaacaaacgatactgacctttccctctcttaacaaacatttttactttatcccctgattctatttccataagattcaaaatattacattcatcttcgatattattgacaccaatactaaccaacactgcggaaatgctttctttaattctgtatatttaaaatcatttaagagctgttgtgcgaccactatattatttattaatgtagagtcattccaaataccatttgtgatcaaattatggttttttcttttttaaccggcatcttgctattttcaataaaacaatataatttttgttacttaacgttacaattttcccaaataattttcaattgtaatattttttactttaaagattaattatagtcaatgaatcttagtcctgaccaagtacaacgaatatctaaataacattcaggcaaattatgttcgagcataataattcatgtcttttatattaaaagaaagttcgacacattatgtattggacctgtcagctttcatctattttgatgagggaatttttaaacagaaaagggccagaagattgaagaaaggggtcaatgtttaaagcaactttgctcaatattgccgaaaacgttttcgaatgggctgcagga

SEQ ID NO: 109031 - DNA, 769 bp, Oryza sativa
ttctattaaatgttgcattcttttacaatgtcatgtgggatgggtcctattactcagccatttattgtttaccttatgccattgataacttgggtatcaaaatgattagatgttggtttaaggaatgcttagccatgcttaattcaactagtagacaaatgtggatcacactattacatggactttgactattagcatagctttggattggtgccaccgcaatggtgtcagttaattaaaatacactgaatggtgggctgtgggtgcatggttttgctggtcgcacccatggcaattaaggactggttcacgggaaaccctgggagacttaccatgcttaccacaagcgggggtgggtaactgcttgatctgatgtatagctcgaccctttcctaggcaccggcggcgagggtgggcgtgatggaattgggtcggccggggtgtccggttgtccagctgccggattcaccacggcgtacgaggggactgcccactgccttttgaggggtgggggtgaaaccttagcgtggtgtggatggttaggggcgggttatgcgaagggtcttgtcacgattttccccatttgtagtatcatggtgatacttcggggcatggcgatatgtatggaatcgtgtcttgtgggtacaattgtacacctctggccagagtaaaactattcgaatagccatgcccacggttatgggtgatcaaccagattcaccgtaattagtctcacctctagtttagcttaatgaactggtctagttca

SEQ ID NO: 109032 - DNA, 683 bp, Oryza sativa
aaatagaaaaactataccaatacgaatacctttacgcgatcttcttcattgccttgatcaatgctgaatggcctttggcttgatgttcatcaacaaatcacatcctcatgttcttcgacattacatcttacgctgtttcttcaccaagggttgatcctcagcaacttgtgccatccatcccatggcctcgatcggttcgtcggtgttcagccaagcacttgctcctccagcactgagttgggtcctttggcgtcaagcctccgcttgcccttctcccatgcatggtccatcgcgtagccaagtattgccaactcttcaccacatctagacatcttccgtcacttctaggcttggatcatagtgtaaacctcattgtattacatctttttcttcatcatcttcatcggctcttcatcgaactaatcccttcttatacattcaataagcgcattaatcccttaattgtttgtcatcaattaaccaaaactacaaatcttatcaaatcatgtttaaagtattcataatggtaaaacaaatcataacaaaataaatgatacttacaagattaatggtcaaacttctgatgtgaaaagttagcagcaccaaatataaaaatatggagggagtacgtcatttaaattgggtccatccatatcggcacggcacctgctttgtttcaagct

SEQ ID NO: 109033 - DNA, 554 bp, Oryza sativa
catacattaaaatatggaggtagtattagcttctcaatctaacgttgagaagcaacttcaccgcaatggtactatggaacttatattgtagaaagtcgtcgtgttgacgagggatcccagtaatcagtcttcagaaatgtatctaacagtgtcagtttttagtcggccatatcatggaggactttttccaatggaagcaagcagggatacctatattgagaaatggagctaccaacattacagttgcatgcagatcgacttgtagctgcagccaatctttcttcaaaacaaatcaaattaaggtcgtcaatcatgatctgatttggaagaaatgttcagatcttcagagaagtcatatctttggtttattaccacatcgaggagctaggaatgtgtttgcaatggaagcaaaagcaggatctacttaattaaattgcgttgagaaattgattgggttagggtagtttttatatcgttttgtcagtttttatttgttcagattttttggcagcctttccctttcttgatctgttatgtacttgggctgcaggaat

SEQ ID NO: 109034 - DNA, 668 bp, Oryza sativa
agggagtattatttttctctgattaatagatctcgatggagcaaattggtcgaagaaggaagaagaacatacaaaaacactttcccccttcctattgtcactctctgttggcagcataataaggtcgtgtttactgtacctgttgatgtgcagttagggatgtaagtgggtagtcccgctatccatataaaaacccacttattaatttattttccagttcccgcacaatattttatttcccgcttatccgcgcccttcatgcatctgtatctgcagtggccaacatctatcgtgtattgtcaaccaagcaaaatctctgtcttttgtgtttaagaggtgataaaatcacaacaaatttaactgtgacaaggacattacacacattgaaccaaagaggtgtgaccatgaacctagcattggatgtccatttcacaggatttttggataatgaaggagagaaagacacatttcagaggatatatatatatatatatatatatatatatatatatatatatatatatatatatatatatatatatatagacacacacactgtaccacttattattacttcctcattggcttgcaactgaataatcaagtcaaagatatatagcaataacaaaaacaacacggattatctacataaatgagcagacaggggg

SEQ ID NO: 109035 - DNA, 771 bp, Oryza sativa
tcagtagagccattaattatatatggtttgtgtatgtaatgtcttttataacttaagttttttctctttcactatggaatcacaatttcctatgaggaattatccatagctatgaccaatcaatgtttgccgtcaaataataaattaattatcatttttttctaaaaaatgggtagagccattaattatatatggttgtatatgtaatgtcttttataacttaagttttctctctttccctgtggaacctcaagagtcatatgtcttaggtaccattttttataccgtaagataccaatcctaatctccaatagataattttataaataacaattaaattcgtcatgcaattctaacgaagaaaattcatgggaaaaaaacataattttaaaacattgcagatattaattcgctggtataccgcctttataagtttctcaaatttatcctacgtacggtgcatgcccgctcgtatgcgcgggctaccttcctagttcgacttaactagcagctctgagaccatgtcgagtgagcttctctcactgacatcgatcgtcgatacttcctccaggttttgcatagccgtcataccagcctgtgcttgcaaaccatctcccaggaggaacaccaatttctttagctcattcacggatacaggcaactgtttcacgcgggttctcctcacatctatggtctgcaactcatggagttctccaatgtcttcttggagctcggtgacaccggtccctctaaggcccaggtatctcagta

SEQ ID NO: 109036 - DNA, 805 bp, Oryza sativa
tgcagccctgtgtagagtccaactaagcaaattattcgtcttccctcgccatggatggtagacatgttaattcgtgtgtccggcagcatgctcacatcatcatacttagaagaaaaaaaagtgcccttcatgtatatacatgtaactacctcatgcccctcttttattaaagaaaaaaaggtctatacccatgcatgcacaccgggatgcaccggttagccctccaatttgttcactccatggacgggatgttcctttgctctagggattagataatttaataagtacaaataagtatttgaaatcaatttttattagtaaaatatccataaggactgatctgtagacaccctctgttcttcttcttttcttggtgtattagttggatttaagcaacgtgatataggtattttgggatataagttaatgtccaacttccaaaggattaaggtttcccaaccctcagcaccgaacacagcataagatcgtacatttatccttaaaagaagatcatatattttatcagggcattggaattaagtaaatagcatccacatatatgtcaagagatataattaagttggttgtgagtcaataggtccattgatgctataattaaggttaaggttagcggtttataagttattttgattttattaaaaaactaagttggatattttgatttgtaatgagaacttttaggattttttgcgtatggatgtgggtccaaaatataataattttattagcaattaaatatggttggtatagatattaaactattgatttaattaaaaaaaacaca

SEQ ID NO: 109037 - DNA, 824 bp, Oryza sativa
ctattcaataagaacatagctgcttgaacaaaaatggtcaaggtattgaagcagcattgctagggagtgcttatcacaacaatagtaaaaagggaagcattcgtctttcaagtgaaacatccagttgcgtcaaaaataaacattcagttaatggtttttgtaaagacactgtctccaccttttttttttctgatcaagaggcgtgaaagcctcccatttccatctactagaaatgatagagtttacagagagacactgtaaactctatcatttctgtctacacctactctctctgatttctgttacaagtcagtttagtcttttcagttttattctaaatataagccaattatgaacttgtatgcattttgtttcttttgttactgctatgtcattgcttaaatgaatggattttcatcaacaaatggtttgcctttcccatgtatctcctaccccatgtctacatgcacggatgcaccaaattccccaatcaccatagaacagagaagttagatgttagcttaaatttatctaagaaaaagtaataatatagaatgataatggttaacatattgtcatttcatagactaccttaattcctatgtgcaaatctgaagggacttataagtacgtatgacatcagtgatggaaattgcagtgtatagattgcaaacactgtagatctgtatgtcccatatgttatctttaaagattccataacaaagttaagcacagaatatatactttatactgtatagaagccaaaagttattatcataccacagtcacatgcactctttaaagataccataggctttaggaaa

SEQ ID NO: 109038 - DNA, 772 bp, Oryza sativa
taaaactgtaaggtttaaaaaactgaaaaggttcatgataaccccaataattgtgatgtaaccgataatatgttacaaactctttcctaaactgttcaaagcaatgcacgaagctcaatagctcatagtagtattgactagcatatccacgtgtataaagccaaggatgatgagtgtaaaacctagtgaagggagttatatatctactccataaatctaacatggcatctagagatggttcctagcaagcattgtagtaacattaaagaaaaatgctacgctatgatcactcagcatgcatgggagcatgccagctcaaggtgtgtacctgtgccgagccagagagaggctaggcctgtcataaagtacatgagtacactacttgacattgtatgaacagatacagttactaacatggaccaccgtttcatcagaaagtggcaattttaggacccctctgaaatgaaatgaatggttgccataggaattttggatgaatcaattttgtaagaaaattttcttatagaaacatttggttcataaaaaagggaggaataattttcataggattgcatttctatatgtctcaatttcatagaaaaataaataagaggtccaacttcttaaaaactttgatttgctttttttcttcatgtgatgttctcaaattactcctttttatctttcccttttttttctatagtgttagaaaaacatgacattttaattcctattcttttatatcccgatattattttccatctggaccttg

SEQ ID NO: 109039 - DNA, 1180 bp, Oryza sativa
gcacggtagatgaaatgtatgtgtctctggcctccacctatcaaccagtgccataagtagggacttgtcgatattttgtcgtcgttttctatgtgcccccatttgtttttgtttaggttctctagcgtcgtaatgcatccttgcctgcgtcatctgcacgaaggtaagaagacctgcagctgacaacctatgaggaaatttattagtcacattaggcaatgttatagtacgatatcatgatgttgcaaactttaaccatttatgcacctcgcctcccatcgtcgatcaatcccccaccatccggctgtacgcggtatcaggacagctagactagagcaagaatttccatcatatatcttctttgcacgatgtcatgcatcgatctctttgctaagcaacgagtaaggccactctcttccatatctgcatgtacatcatgaagggtaaattagaaatttcatcaagtgcacatacggaaaagtacatatgcattaaattaaggaataaaattttctcatagtacaagtacaaactcgagcaatatcattgaaataaatagtacaacaataggattacaaacgttacaaacttggtaacaccttacaataaaatcttacaacattaccataataaaataaatattacacatacttattgactaacatattacaaacttattgaaatacaacgtcatgcagcgaacatatcatgaccgaacataaataaccggacagtgtaggttataactactgcaggtttccttcctccctatcgtgagcaccctgagagccccttctattccttctcgcacgttggtgcataaggtccatgggtggagatgtacccctcctggtattcttgccatcttcttatgcgcgggcccgacctgaagacagttctcacatcggcttaacgggccttccgctttcgatgcttccatatctttcttaaagcgacgtgtttgtcttctaccttaaccggccttcaacaaatccaagtctggcacatagatcctggtatcaccccaagttccgactaggtgtgggagggacctccacccgaggatctcagcactccatgcatttagaactctatcctttaggtagaacgtcgacacgtatgatgttgaatcaagcttaattttagcgcatgcggccaggacatggctacatggcttatg

SEQ ID NO: 109040 - DNA, 643 bp, Oryza sativa
tttagtctcaaggtctatgttcttaactgtgtgatggatgacaggatgaacatcattattttgtttggtaatatgtactgcctccctttgatgtaatctcgtcaaaactatatgtagtagcagtttgtgctgttatactatctccctctgttcaatggacagtatcaagtttggtttgaaattagctaattgcatcataccatcaggcggcagctacggctccactggaatttaacttcaattactaataaaatcaattcgcataatcaccacccaaagatacacgacttcaattattaatagcaggcaccatattgcctaaacacaacatgcgtattcaccaattccttactaatatctatccgccggcggcggcagcggaactgagaaaaggggtcggcgttgggctcgggcactcccagcggtggcgtcaccttgcttttagcaatttgggcgagaactcatgacagacggaaagggattgcggcgctctatatcgctattggcgatttgggtggtgccgattggaaggaccaatgaacgataatcttgtctattgacttatttttccaatcatgcccctgcttaatcaatggctagattagattggtacctcatggtacctagtacttcatggtacctc

SEQ ID NO: 109041 - DNA, 819 bp, Oryza sativa
tgtttcagttgttggtgaaagttgtgcattctctctggtcttcgtacattttccacgtagaccgtctgttgatggttgttgcgaattgggcacatatttccacggagcttttatgtcttcccttttcctcaattttttttttaaaaatgggcatttatatttctttatcctcccgaagttgtgttttcttggaattggttatcatctttacatattgtccacttatcggtgcattgtactaccttgctaacaaactctagattaatatctttcttcagtaacttaactgttattagtgttaatgtgtaggcactaggcagtactgttactgtatgagatcagtgtgtggggactgaattgtgtgtctagattttctcgcttaacagttaccaaacattgtcgatgcccatgtgcattttatcagtatcattgataggtaaataggaggggaaagtaccaaaatacactggaggagacaatattgtttttcatttactttttgctgatgtagaagcagattattctactagtcaagaacagtaggtattttgcctattagctgtattgcaatgtagtaacagattgtggtgtgtatgcagatctcatgctcagcactgaatgcgcctgcagacagcactgatgaagaccagggataggctggaggagcccactagcatcaagaatggtttgtcaaggtgccatccctatgtccattttcctccttattcatgttctggaccacaactgcatggatccactatggagttttctatatgtaaatgtgtttctctaagccaagtagtataattatgtttatat

SEQ ID NO: 109042 - DNA, 614 bp, Oryza sativa
ttttatatattttttcttaatgacctaaaattaagttgaaaaataaacttcgatgaaaaaaaaatcccaaaatcaactccaaatttaagtttaaaaattcaaattttgattaagcgaaaagataagtccgattgtgacattgttttcactgagggttatcagctccaacaactcttatctaaactcctcagcaaaatcggggaaaggctgaaagaaccacttaaactcagacagattaacacatttctatcatcgtatttccaaactaaaatccaactactgctcataagttcctatcacctttattattagtggtggagtttgagctaactttttaaagggaccaacagttaaaaggagaatgaaatacataatatttatgggaccattttacagtgtctccataatcctttgtcccgattcaacttggcctttatacattttaattttttttcacaatgcacaattgtttcatatacttgtaaaatggttgcaactaatccaacaacttcacttcaatgcctgcaccatatcttctgcaacttttaagccacttctgctgccatttgtctccttccctgtgactgaagttcttgaactgaaataaagaaaaa

SEQ ID NO: 109043 - DNA, 646 bp, Oryza sativa
aggaatatcgtgtcatttcaatggtactgcataactaaatctacaatctctgatcgtgcagccacagtgggcgagaatccaggtgcacaatgtgtacgagtactttaccgaggcgttcgaaagccttagggaaaatgaagttcggtggactccgtacacgaacgaagaggccattttgcgtgcaccgcatggagtaagcatcttatgctatcacgatgaagcgtactggatgacatgaaaaatgttggtgtacgacatattcgtcgaggggtataatgttcaaagggtaatgcgtcagatgggactgtaccaacaagtcccagttcctgttggacttcaccttccaccagatgtgcacacgtatgttgttatttcaatcctgtctaatttctgtgcactaaaaattgtcagatataactaatagctaattgttgtatttttgttgcaggcaaaagaggcaagctgacaacaggtatcgtcgatctatgcactcaaggatgaccccatggatagaggcgtggtcacaggccttgaatgatgtcgtccaggagaccagggcatcgaccacaacacttacgaataatacatggcctggtactcatcgcagactctcatccggctgcttgcaccggaggatcccgacgag

SEQ ID NO: 109044 - DNA, 527 bp, Oryza sativa
ttgctctaattctactcgtcgttgcaattctctctgtaatttgggtgtgagttgtgggttgttacacagtttatgaccagatacaacaagcaataagtgatttacttgaaccttaattaactactcgatccgtgcaccagcagggttcacgatcagaagtttgggaatcctcagatttccaagcaacgcacatacgctatgtatctataaagttcattctctcttctctcgtaaagctacataatctcaattatttttaacctttggatgattcatcaaaggtgtaaattacatctcttcctctcaaaaggcacaccatacaacccaatcatttataacatttggataactaataaacgtaaaaaatatataaacacatgaaaaaaaatcgtataatacgtaagaaagaaaattttagaactcatatctactatattatcacacaattcttccgtagcaacgcacatgatacccatatagtacaatagatgattctctctggttcgcatcttctccacacctcacgg

SEQ ID NO: 109045 - DNA, 760 bp, Oryza sativa
agctcgtttatcttctttcgtatgacagtatgaaaaaaatgctactaaagtcgcatttacactagtgattgttttgtgaccacaaattgttcaactatgacacctgcagatactataagcatgatgcattggtacatattttagcttactcagaaggcagagtgcccacaaatcatgttcatcccatctccagcaccgaatgcgtggccatggataaaatggaaatgaatccaacttcgagaagagtaatctatgattcacgtcgtacaattggccaacaattaaagctttatcaaatatcagttatccgtgtgttgcttcggataatagaaatatatttaataatatctcaaattttgcaaaattataatggcatggttccaattttcccttctattaaatgtgttaataatatgtttgctaaagggaatattgatcctaatttaattttatacatagctttccatttaatgcttgtttttctaataataagatgctcaaaggctaatttatatattggatgggaataggtggggtggcagattcactgccaccagcactattttttcaaaggagtatagaccatcataataccagcgtgttacaaaggatctcaaataattatatttgattattgtgtggtttcattggctaatcaggtgcgaatttggtttctggataactggatttgctcctcctttggttcctgtccgtttcttgatttcctccggctttgcattgattaattccactgctctgg

SEQ ID NO: 109046 - DNA, 656 bp, Oryza sativa
aaggtgtactttagcatctccaatcagcgagatggctacactgagacgcctcttcatgccaccactgtacttcctgacttgcttatcaggagcaccaccatgaagtaaatttacacttcttaaagattcgttaacagcctgcaaatcattttcatttcagtaaataactctgaaaggcttctaaatagaaatagtaggaaagcgtcctattcagtatattatactagtaaatttagaagtactgtgtcaaaaaacacatactgaaaatatttcaagacaaatgaaaatgaaaaaaggatgatggagaaaatcagggaagactatctagattatatccattttttcagttcagagaagtattttgctccatgaaaacccatgcacttgacactttatgcttcaaacactcttccattcttaatacatggttcagtgctttcgagcatccactcatttgttcttaattcaaatcctataaggtttctttggagtataaaaatccatataataaagcacatctacgggcataagtattgaaagacagtacattgatattaagatatgctagcttcaccttaaaaattatgctatcagaagaagaaataagggacctggtatacttgatataacttacagtgtccaaatcagagccattg

SEQ ID NO: 109047 - DNA, 1032 bp, Oryza sativa
agtaggaactccctgagtcaaccaacatgagtatctcagtgccttgtatccatctctcaaacgaatcgacttggaggattcagtaccccacagagcctgttgggatatagccatcaaagtaccttcatcttgctctttggttccttcaggactagtatcattttcagaataagattcagactgcagagcctctaacaattcatgtacaacatgtaaatgtactgtagtggcacatttatggtccctaccccatctctcaccacaaacaaagcacaaccccttagatcttctgtaggccttgagtgaagccactctgtcctctttaggtttggttgattcagtcaccttaccaccatcagaagaactaccaggaaaaaatttatgccctggagtggcaggaatgaagctagagaatcttggaacttgtttatagacagatggtgagtcggctcttttgctaacagtgggtttgcaactatccaggatttcttcctgaagcagagcaattgaacaggcagagtccaaatcctgaggcctctgtaacatgactacccctctgttctcatccctgagtccttcaatgaacttggtaacaaagtacacaggtgtgagggcactatcataggccataagctgatgcatgatcttatcaaaattttccacatattcagcaacagtgctactctgttgagcatgaaaccactgcctgattagtgcctcctgtctgtccctagtgaatctagagcagactaattcacataaagtgacccaggtaatgtcaacaatctgagatctaatggactggagccaaaaggcaacattaccaacaaaattaagagtagccaccttaacccaatacataggatatattccatagacatcaaagtactgcttgcaattacttttccacatctgggggttagatccatcaaattctgggcagatcattggggggatacaagcactcaaatcatgattggtaccagtggatgcagaagttggtgatggcaattcagactcggtccttaccag

SEQ ID NO: 109048 - DNA, 1335 bp, Oryza sativa
caacccacaactcacacccaaattacagagagaattgcaacgatgagagaattagagcaagaggaattatggcaactcaatatagtagtcttctccgattccaacaggaatggagccgccgccgcctacgccaccgtggttgccattcaagtttccctcgagctcgctgatctgatatatatatcctatctctctcttctttccccttgttcacgctagcctattacaatatggacttctattacatggcccagttaggcccacagtacttggggttttgcttaacaggccttgtagtacgacgcagattgcctccctttgactgcacagctccagcttgacgatcttcaacttcgtcagagttttgctccccatcttcagtcaatggaacatcgccaggtaccgcctgctccttgacataaacatgcttattttcttctccgttttgttaattttgccactgaatcttacagatatatgttgttcatcccatttagtagtgcactgtgatagcacatcatcacaaactaggagagccgttggatctattcccaatggcttgattgcagtctctcatgtaacgggcacgtgtgctcttgcatcgggttgcatggaaattattgatgtctaaataattcctttttcaaaagcgtgcaagccaacaattgtttttatggtcattttgttgaaacagaccattgacaaataaatcttaccatgtgcccttcccacatattgcagcgaagctatatatgtgcacatgattttgaatatgttgtttatgtaggaattatggtaaaaaggtatattatttggtcagccttcaccgagatggttgtttacatttgatttttccaatgttttaatacatatgtatatctagaacaatgatgttcatctatcattttgcatgtaaaaaaatcttgtaaaattcgcatttacacttgtgattttttttgggatttctttttgggaaacacaaattgttcgacataccatattatgacctgaaactataagcagcattggtggttcttttagcttattcagaagttaaaacaaactatatatttgtggatgtgttctagtgttctaacggatgatggattatatatgaactatgtttattacaataattcaagggcacaacaaaagaatagataatcattttccgttaaaaatatattatagtgagtgatgaacctatcatcgcttactcccaccaccacctgatatgtgggttctattgaatagtgagtcatgcaaacggttccttctcaaacctaaacatgttcaaatattgtttgtagcaacgcacgggtgtatttacctagt

SEQ ID NO: 109049 - DNA, 1424 bp, Oryza sativa
ttcagttagcatagatcagttcaaatccttactaaaatatagattttattttttattttttcttcaacattaaatcatataaaaaattaatcattgccgtacatgtgctatcaaatgttgtatatgcaacagtaaatattcccaaagtaaaagatgaaattggtgctactccaatttgtcaaaccccgccttggcaccagtaccgcgtacaatggtacgggagacagtgtgccatggaagacagcgaacacttcagcactaatgttaactgcaggagtttaagacatctggaaaggaaaaaagggcccaaaaaacacttcagcactgtcacgagcttcggtgagactattttgcggagttgaatgtaaagcgtagccgtggctggcggaagggcaagggcaaagttctcctcgtcatcccgacgccgtaatggcgaagagagagatagattgaataaatttcttcttattcgattacttcctcccaatccctttaaataggaaaatcttacagataacaaaactcaatcgtatcctaatctgaaagtattgattaacatcctactaacttactaacaaactctagagataaaacgaaattaaactaaaacattatccttgtttaacttgagacttatgcctactctgatacttacgcccccacatgacaagcactataattgtaacaaaaaaaaaaacctgagaacctctagatgcatgaagataatgggaaaatgacagtgaagagaatctgataaagggttgaccaaacagaatttctcagagaaaagtaaagttgtctctggaaagatcaagagccgcaaactgcggcgccttttcagctttccccccacctaaagggcacagtgacattattctcttctttagaaaaaatgatatggcattgctcacacatgtcaccttgccacagaatttgttctggtccactacaatctaatggtccattttgtaagtaacataccttctgttatttggcaagcctagctaacgctgtatatgaacactacgcagtttcttgcccaaagagtaggtcagaaaaaaattgcacattgtctcctccaaaatcacccatatgcaacttgactaaatcgaatttaaaccaatgagcatcgaatattgacgagtaagtggtagggcaatctggaatgatgagtccaggggtgaaggaatgttctctcagaaagagattaatccaaagtcaaagagggaatgggcatgaattctcgctgcctatcagccaaccacttagcgacagaaatacccaacttgtgaatattaattgataataagagaataggcatcagtaacttatattgatcgatctggatacagctcgcgtgggagggaggaacacatatcttggagtactgttgattcctccaggtttcctactaaactgaattc

SEQ ID NO: 109050 - DNA, 6766 bp, Oryza sativa
ggttagctctttctattctttatctaggacaatgacactcattgagccgcatcatgttctttgctacggactgtttgtacctacttagatatgaccaccgaaacaatactactattgcaaatttggatgagtacatttaatatattactactttaactataaattatctaacggaccgtaactttacttaaatacaaaatatttgtaactatcagttagtacaaaattatctataaatttatcataacatgataaattaatagaactaagtttaacttcacttgattaattacataatcaaattaatcataactaccaatttattatagtataaaactatttgcagcgacataaatttatttaactgcactttaattacaatatcaaataaattacaaactgtctattaattacaaactgtcttccattatagtaccataccttgtcttgccttcttcttttcaaccaatttgctcatataaaagtcccaatttcaaagttcttcgtactactgcatttatttgttcgttcgtaacaacctacaatgtaaagcacgtgtttaagcacaccatatatttcccgctacttaacgaatatttataccttttccatttctcacaaaataaataaatgcatgaactactaagtaattgtaacttaaattactacaaattaattacaactttaatttaattttttgtaccacatttaataattatcaatactattaatatcaatatcaataactacaaatataactattaatattttattttttttcatttcttacatataatattggtcgtatatataaaattaaacatcacatgaactactaattaattataacttataattactactacgtacaaattaattctaacttatattatacttatgtaccttataaattaattatgtctatctatattttaacccgaatcgactctattaacattctacatttctatttttacatacgacctaacaaaatataatgtagttgtaactaatacatacctaaatttttctctgacataattacaaacaaatattaactacgtgaactaatattttctaaatcctcatcgtacgaatttgtgctaatagaaaactaatcaacttacgtgtctttttttccttctctccactgcatgcactgcctcctctcttctcttgctcttcctctcctcagttcactcccttctgtcttcctctgtgaggaccatctcctctcctctcaatttaagcccgtgagcgcattggattctaatgctagcagttacaaatggccggcatgatgtgactgcaacagtaaactgataagagaatgcacagagctcttccacctctccctaaaaagctaaggtagatggctataacccgtgcaaaaagcaaaaaagaaatagagatgggaaacaaaggtgtcaatggagaaaagcggcgacgctctcgcgcatgcggagcgcgataccgagggcggtctcgcacgtgcataccgcgataccgagcctactgccgcgccctccatgcactcgctctcgcccacggtctcgcgcgcgcaaaccgggacatcgctcggtctcgctccctcaaagcgcaacagcgctgccccacctcgctcctcgctctcgcgcacgcgtatagcgacatcgcgttcggtctcgcgctcccaaagcacgatgccacgggcccactgccctcccccaggctttctctctctcgcgcatgccgcatcagcagtctcgcgcgcgcaaagcgcgataccgcgtgcccacgtcttctccgtcgcgtcataaccggtctcgcggtttcatattacgaaaccggcatcggtctcgcgtaacgaaagtgcaagagcgatggctccgcccgaggtagtcgtggggatttctccacgtggcgctctcgctcgagggaaaagcgataccgcttcggtctcgcgtctcgcttgcgcgagagcgccagctcaacttcgctatcgctctatcagatcgcgatttcgccacgctatcacactttcaacgagcgaacatcggtatcgctattccaaaaagcgataccgatggtttatttccacaaatcgttcgctatccggtatatttttgcacaatcaatcgataaacagtataatttcaaaaaaatttcagtagtatgtagctaggtttgcttcgtgcagctgtgtgatccacctgtccatgttaagagactgataaatactaactgggcagaagcttcagaaccatgaagatagaactgcctctgtaccattaatattaactgtcttagttcacgtcaaaattagaattttgattgaaattgaaacaatgtaacggaaaagttaaaagtttatatgtgtagaaaagtttggatgtgatagaaaaattagaagtttaaagaaaaagttgggaactaagaccctatttagataagactaaaacttttaagtccctatcacatcgaatgtttggatattaattagaaatattaaacatagactattaataaaacccatccataatcttaaactaattcgcgagacgaatctattgagcctaattaatccatgattagcctatataatgctacagtaaatattctctaattatggattaattaggcttaaaaaatttatctcgcaaattagttttcctttatgtaattagttttgtaagtagtctatatttaatactctaaattagtgtctaaatatagagactaaagttaagtacttggatccaaacaccacctaaaccatgccttagtttctggaccaggacattgcagctagcctgacactataacagcacaatcatctagaatcttttggaggtccagcctgcgagggtctggaatttgtgtgtttgttatttgggtggaaagtttttaaagtatacggacacatatacttgaagtattaaacgtagactaataataaaactaattacagattccgcctgtaaactgcaaaacaaatttattaagcctaattaattcatcattagcaaatatttactgtagcatcacattgtcaaatcatggtgtaattaggctcaaaagattcgtctcgcaatttacatgcaaaatgtgtaattggttttttttcatctatatttaatacttcatgcatgtgtctaaatatttgatgtgacctttttaaccaatttttttaatttaatctaaataaggccttattggttttgtgtttgcttattgattaaccctatatctgactatctgactaggtgtgtctttctccgatcaataaaatggtggatttattaatgcaacacaaatctccgagcttctaaacggctaacggtgtaattttcataaaaaaaatatatgtgaactggtttctaataatcattttaaatttatttttattttataatagttaatcaattaatttgtaccctcgaaaagttaccaggagagtatccatctactccctccgtccaaaaaaaaaactctggtttccgtgttcaacgtttgaccgtccgtcttatttgaaaaaattatgaaaaaaattaaaaagacaaatcacgcataaaatattaatcatgttttattatctaacaacaatgaaaatataaattataaaaaaatttcatgtaagacggaccaccaaagttggacacaaaaatctaaagtttgcttttttttttaggacggaaggagtattcaacattcagcatatagtaataataattcctcagtgtgcagcaaagcttctgaattcttgcgtacccagactagttagcagcagtcaaatccacatctttgatctacgtacagtaatgcagtttacgagcccgggcgactcgcgcgcgtacgtgtgaccgctcgtgccgtggacggcagcgcgccgctcgctctacgtatacctgcgcgccacacacaccgtcgtgtggtcactcctttttttctcgggcccccgggcgatcgagcgggcgcgcggtagcttcgcgaagcgaagcacctgaatcacctgatgtccagagaacccacgacgcgcgcgatggcgatgcggtgtcgatctcccacggtggcctaccgatcgatcaacacaacacacatcgcccaccacacgcacacaaccacacacgcacacggtgtcgcgcgcgcgcgcgcgagggccacacgcacgcggacgcggtgatgcgcgagacgacgcgcgcgcggcgctagctcacacggcacggcacggcaacggcagagaatctcttcgcggctcgcgggacgggacgcgtcgccccggcgatctgatcgccaacccaacccaacccgccacgcccacgcgcacactccccgcgcgcgcgcccgcggctggctggctcgcagcgcacgtacgtggccacccgcgctctcgcgtcgttgatagacagggcgcgcgcggcgccaacaccggccacgccgtcatcgcggggatcaagcagaacacatgtttgatacggctgttttatcgtttccgattaagatacatattttatcacggttttcactttgtgtgagggctatttatttcgtgcttaagatacatattttatcttggttttcttttttcaaatggtttgataggggtgttcaattctagatacatattttattccggttttcgtttttgatacggttaaacgttgtatttcctgggaaaaaattatatcgaaattgctataacatatcgtatcaatctattttcaaatctgtaataaataaagtgttcttttatcctaacttcacctttagtcttttgagtgatactccggtgctctctaccagtagtattatactaccagtagatatgatctgaaccgtttgttacaaaaattaaattaatactacctccgtgattataagacattttgacattggtcaaaatcaaactactttaagtttgactaagtttataaaaaaaataatattttcaacacaagacaaattattatgaaaatatattcaattattgatttaataaaactaatttggtattataaatattactatatttgtctataaaattagtcaaacttgaattagtttgattttaactaaagtcaaaacgttttatagcctgaaatggaggaagtaatttattaagactaattagggataactttgtcatatactttttttctttctagatcgatatgtggtcattcattttgctggtatcgcttatattccgtaaaaaaaaagttggaagttttagccactgctaaatgctgattatacctttccataactattttttacataatgccctttatatttatactctcattagcagggatagtagtacaaacaaatttaaactttttgattaaatgatattaacggtttagattatattcaagtatcaggaaatagcattgtagtggggctcagcatcctcagatgttttgggtaagcgccgtgtctaaatccaaacggtggctaggacgattctaacacttctttttaagtactaatcaacaatttacaattggtctctcgaagcgtggcgcggtgtcgcctatctccacccctcaacgaaagtggactaggatattttcctctccgttgatggtgggttgctttaccgcgacgtaaccacgagatagtcacagcgatttatacccacaatgtggtcatcaaccaatacggatcgatctccttctcataccacgagtatataatattctacgattgtgaccatattaaaattgcaaggccaggagaggatgacgagtagtaccagtggtggcaacgtacgacgttcgtgttggcataaacaaacgaggggactagattcgatcgcccaaatcttttaacagctcgtcagcaacaagctgaaccccaagcatatcgttctctctagccacagcaatattttactaaactaaaccgcaatttgcagtgcgacgagaaggggatggaaaggattttttaatttgatcctaatatataacaccgtgcgtctagaatcgtcaaacgctaaacaaactcacaagtggcagatggaaatttcaaacaaataaatccatgcccccaactaggaattaaacaaatccaaccccaaccgaaaggaaacagcaattccatcgatcagctcccatccaggacaggcgaaagaagaagacgaattaaacaccagaaacaataaccaatcgtgacaacaaacaaaaccacgaccaggggaggaagtgaccggccggtgggcgctgaattcgacccgggacgatacgaggtttgtgtggccaccaacgcctctacgatctcccaacgagcggctccaattaaccaattttaggccattagccccccataaccacttgtgtcaatgtgtgagcctgatttgatcctgctaataaagtatcccaactcctccatggaaatccctccaagtgtcgaccacccatcgatccaccgatccaacggtgtacgtttatgtgtgtgtgacagccacagcgacgttgcgaatcctgtttcgttagagagcaggtacaacagcacactataaaccaactctaaatatattttaaaaagataaaagactagagagaaaaatagcatactacatatttgtaactagatatagcacggactttaaagacgcagtttgtgtgtgataggtgagatcaggtattagtagtgttgtatataactattgtataaattgaccgtagatgatttcgagctagtagctggctatcctattaaacttgctcttacgaaagattttcgtcctcacattccgtttcccatcattccatgtacgccgctg

SEQ ID NO: 109051 - DNA, 548 bp, Oryza sativa
cataatattgtttactaaacaaagaagatccatgctgctaattagtagaaaaattttgaaaatgaaaagaaactaatagttgctgtaaaaacaattgttaaaatatatcaggtaaagtaggagaaaaaaaattaaaaccatatgtccatctcaagtaccatgagtggggaaaaaaagaggaaataaaaactgaaaaacttcaagatacctgaaagaaaggaagtaatgcctcatcagcaattgtatcgcttcgatacattgattatgtggtccaaaagcgaaaaatgtagcagcatatacataagtcaagtttacgagaaacggaatggcaccaaaaccaactcacctgcactcctccagctgttatactccctccgtcccaaaatatgaacatttttgaaatagtgccaagtcaatcatttctaactttgactactaatagcaagaaaataaaaaagatcaatcgtgtaaaattgatcttactagatttataatcaagctatcataatatgtaactctttttatttgatttttttttatttttatag

SEQ ID NO: 109052 - DNA, 636 bp, Oryza sativa
acggttaacgtgggagctctacgatatcactacggatgacgatgtggatgaaaaaaaaaagctacgaaaatcaaaatccgtcgtaagtttttttttaagaaaaaacattcaaatgtaattataatacaattataatataattatactataactactgttactatagtgtaacaacatgcaactatgagataactacactttaactgtaatttatatattcattgcttgtaagagcaagtataatagtaggctataagactaaatgctgaggtggaggagagaagagaggagagagaggagaagcgagctataaacttatagccggcttggatataagaacaaagaaactctgtgaaagagacaggtgggtcatatattaattgtaaagagctaactattatatggatgagctgagagaaagttaccaaaaaccttatagccaataaatcggttgtattattacccttactctaaccaagagaaaactttgatagctcggttgtgcatggcatatgcgcgtggtgtgagcgggaagttctgggttcctcttccccacacggctagctaattctttctcagctcagcacaaatcttcaagtgcattgaatggttaaaaaagtcgaaagttttcaacca

SEQ ID NO: 109053 - DNA, 693 bp, Oryza sativa
caagcgcattccattgatccaggttagcaagacttcggcacacaaacatcacccctaccgccctcctagaattagattaaaccatagaagcttcttgctacggaaactgttggaagccgttcatctaatgcatataaagcccctccttctatgaactcgtcgtcgacctatccatgaaatctccaccgaaacaagcctatcgtcacaaagcacagcgaactcaaatccatctctaatggcggatccacatttgacactcacggagaaacttcataccaccacaagaactagaaggttctagaagcaaaaccgcgacgcgcccgcagaggcaaattaagccaaccgcagcgagatagaaaggaaaaaggagggtaaggttccagaagcttccactcacctcgatggcttcgcacctccgccggcagctcggtcggtggcgtgggggggcgggggaggtggcgcttaaaatgaggggcaggagaaggatccagaagcggcggcgggttccactggaaggatctagaagtctcgagacggcgcaatataatacgcgagcgaatcggaaggtgggggaggcgaggcgaggcgagtggaattggaatttcgacgagagggagagggagagattagtggggtcgttagctgtgttagtgttaagtatatttattaattgattgattaattaattcgggg

SEQ ID NO: 109054 - DNA, 819 bp, Oryza sativa
ataaatttgaaaaataatttgaatttttgataaattttgtacggtttgtcgcggttaccgcggttaccgtgcggtaaccgtgcttaccgccggggcgcggtacccgcggccccggcggtaaatgaaaccctgctctcgatctttccgtttgcaatgcatgccacgcgagcgcgagcctagatccgcggcgcgaccggcggtgtgtgtgctgctgctacgccgccgtcaccggctttccggcatccacgtggtggggggctgcgtacgacggtacgacgacgaacatgcagtgtttcggggcccagacggcggtggtcggcaggcaatggctttgcttttggctggcctgcgactgcgggagggagaggagggtaacatggggagcggcaggtgggcttggggaaagtatttacagctcggcgtatgggacgacgattactggtggccggtggctgctgctgtttactgctactacaactgcaacccttcgttgccttgtcgatttgtcatccgcgcgagagcgctccgggacaaatcgatggtgtcctcactgccgactctctctcaagaagtcttgggccgtgtttggtagggctataaacttcaactcctagctctaaattgctatttcagttggagctagctcctattagagttggagacccatccaaaagtgtttgacaagcttttagctcccgatctaaaaaatattgaaaaaaaggaatccctgctgccggccgtgcgccgcccaagcatcgtctccacgcacgccggcctcgcgctacttcccctgcaccacccatccgcccttgtcagcgt

SEQ ID NO: 109055 - DNA, 1172 bp, Oryza sativa
gctcgttaacaagctctatctcatttgtatcaccattataattttaaatttaccattttatcatatactaacatgataaaaaacactaattaataaaggaccttcatgttctatctgctattttacgttactccttgaattggacttgagggtacagaattgcgatcaaagtgcagcagtacacaaacactggatttatatcgaatccagaaacataaattcatcataaaagagctaattattacattcagaaatgtgcctctattgttcagctcagactcatcatcttgcatattaccatgtgctgaggtaaaaaaaaaagtcaaatagctgggtacactagaaattattcctgcaatatgatctgtaatgtggaacctagtccactacataggttttttcctacatctacctgggcaatgagtgccttcatacatcgagggcacaaaaaggtagccttgtagtttcttttaacaatgcaagcccattaagtatgaggcaaacgcaatgttcactatggattaacagaaacaagcaaaatcacaaatgttttctgatagtttaattcagtgtaaagaaacaccatatttacctgtaatcttccaaaggagcctgtggttcaggtcttacagactccagttctaacatgaatgcactagaacaagattctctcgggtaatcctttgagttgtagcaaccaagaacctttgattcgaaaatggatagaggatttagaaaccattagtccagtggtaatagtaaattctagataatttggacagaaaaatgcataccattttccatggagcatgtgtactttggtcgcaaatattgatgtctttggcagagatggatagcttagaaacaaaaatatccccatctggatacatattgaactggatattgagcgcagacataataaactctaaataagacctcttgtctctgccatttgagcacggccggctaatcgtatctttctgagctaatttccagtcatttccctcgtacatccgccacttgacatctatatcatgaataagaacctttcctttcagactgcacgattcatcagaattcaagatgaaaatagcaggcttcagtttttgttgaaatatttgctcttctcgtggtttgttcctttgaacatggttttcatctattgtgggaaa

SEQ ID NO: 109056 - DNA, 1022 bp, Oryza sativa
cgtgtttaggtccaaaagttttggcgtgtgatatacagagatatatttgaagtattaaacgcatactaataacaaaataaattatagattttgtctgtaaactgcgagacgaatttattaagcctaattaatatgtcattagcaaatatttactgtagcatcatattgtcaaatcatggagcaattcggcttaaaagattcgtctcgtaatttacacgcaatttatataattaattatttttaggtttatatttaatactacatgaatgtatccgaatgtatccaaacattcgatgtgacagggtgaaaaattttggcagggatctaaacgggtcctaatgctgcatatggaaggggaaaaggcacgtgcctgaaatctagcaaatcccctgtggaaaaattggcaccggccaacgtcgtcgtcgccattaatgtgatccatggttgtattacgtggcatcatgcctctccccgccatgttggatttgcctcctcgatttgcatttgcatttgtatttcccgcctgaattttttttctgtgcccatgcgttgatgcgtacttcttaacttctatagtgcatatcttttttttaatgaattgacgagcgccaatttcattgaattgagaaggagtagctttacaaagcgaaaggaaagaaaagaagcttaggacctttggtctgagctaactaaaagaaaactaattacgaagatttttcgtttctgctaaggcccaagttttggcctcttccttgatcttggctagaagagaggtagctgaaagctccttttgttggaaggttatgcgattcctttcgttccatatcttctagccgaccaacagcatcaaagtgcggagtgccttattgggtgcctcttgtattttggcaagataacttttgcaggtgtcgttcatcaattataatcttttaggaggttttctttctctgttctctcctcgttgtattctccgtgtattctgttctcctatcctccagggcccctgcgcttgcgtaggtaaa

SEQ ID NO: 109057 - DNA, 609 bp, Oryza sativa
atgtaagcataaatttaatatcagtgaattcccttgagccttaaataaactatagattagcagcttagcagcaaccattcttaactgaggaatgaccaagaccaaagccacccagtataatcaagataaataaaacatgattagccatatttcagaaccatgtgaaagcaagataaacccccacaccctaaccaagtaactcacaaaatgatgcaatggaacctcaccaactgggcacccaccattacccccgagcagatggcctatggctgaggacgaaacatagcttggcctatgttcaaactacagcaacaacatggtaagctagtcaagcactcagaagtcagagaggagagagatggaccggagacgaaacatacgcacctagcggtgaaggggcgggcagacctgcagccgtgggcacccgtcgatcccgttggggacggtgtgtccagccaatgaagatgtacgccagcaggccttgatagaatagcgggccgatggctgaggacgaccgtagcagaagattgtgtggaaatcagcgatggcagcgatttcggctcgacggggtagagagacaaagaaacggcggcgatggagactgcgcgg

SEQ ID NO: 109058 - DNA, 701 bp, Oryza sativa
cccgcactgtgttgcaaaaattactaaacaattctcaatatatattttgagacaatgaatataggagttaaaatgaaaaaaaatgaaattctggtttatcagtacttatcatgaaacaaacaaatgatacccgcactttaatgtgaaacatattgataagtataatttaaatattataaaaatgatagataggtttgttaaaatattgtgtaaatgatgtaatggttgataattggatatggttacatgttgatttatagaattaaataaattgtagatgaagtatgcttgcattatgttaaatatgtaattattgatagtgagtgatgatgtgttattgttgcgcgttgagttgtaaatttagcggactataactttattatagaaaatataaataggtagatacatcatatcatcattagtggtaatcataaagcttagcatagttgtaaatgttactacttcctccgttccgataaaaaacaaatctaaataaaaatgtgacatcacctataatgaaccggataatctcaggtggtatcacacttccatctagattggtgtttttttttttgacagaggtagtactatgtgtttacacaggcgagttgaacaaaatactagttgtatttttttacagaggtttcgcggtgaggaccaaggggttgattgggaaaatatatagtacaaaccacatatat

SEQ ID NO: 109059 - DNA, 1245 bp, Oryza sativa
ccagtttagcttttagcacagttttgcacggtgtgtgtgtgtcttctgactcgtgtggtggcgtatatatagcccgcgaaatcgacgcagtgcaacacgtgctggcacgtcgagagcacccatagcggcagcagagatgaagcttcttccgtggaagcaggactcttcgatcccggaatacaagaatattaatcctgggaaacccaaatttccaaccaaaagaaaccccgaaaatttttttaaaaaattaaaagagaaaacctttcccggaatcaaaataaattttgaattggaattgagcccagtgggaaagtatggaaaactgaagatccggttgaaacacaaaattttaccgggaaccgctgaaatggtggaaactgctcccttcgtctcaaaataaagcaacctaccatcagatgggacatatcctaatatccgcctataataccaaaaacgtgaactttcgatgctatataaccaattttgcccattattaatgagaaatggatatatttttcacaaggccctgggactaggagggaatttggccggcgacaacatcgatctgcttgtaatttaaatcatttttctcggagaatttgacttccataaaagcgtgaaaaattgatagtactctcgatcgcctcgccacgccaccgacgatcgaaggtgcgtgctcaagtcagacctgatttagtcctggatcaagttagtcgctgtcattagatttcttgtcagcgtctacgtgtttggcgccaatacactcgcggggtgttcagttgaccacgggatgcagtgatgatatgcctcgaatcgcgcgcgaaaaattgcaatttgttccgatcttggcgggaagttaggccattcacattagcttcttcttaggcgtgtgatcgaattagtacttcctccgtattttaatgtacgacggcgttgactttttaaccaacgtttgaccatttgtcttatttaatttttttatgcaaatataaaaatacttatatcatgcttaaagaacatttgatgataaatcaaatcacaataaaataaatgataattacataaatttttttaaataaaacgaaaggtcaaacgtttgttaaaaaatcaacggcgtcatacattaaaatacggagagagtactagttaatcgtcaagccgacccgatccgtagtcgacggtatagccagcgcccaaccgctgacaattggtagatacagatagataaacaaggagagatgtgtt

SEQ ID NO: 109060 - DNA, 963 bp, Oryza sativa
gtttgagtatatagctaggttatgtatttaaaaccaccatgaattaatatatagacctagcagtagcacaatggggattggatttaaataaccaattcaaaggtcttacgatgtaaatatatttattctccccaccgcaagtcgtttctataaatgatttttgtgggggtatggatcaattgttgtataagggaagcattttgtaaaaaaaaaaaagagtgcaaacgtttcgcttatatttattcgttcagcttattagcaaaaaaaaataatattcgtgaataaactgttatattggtgtctttaacgatttattaaaaataagtgctataaaattaagtcccagaaattaaattttgacatataaatataagataaggctggaatctcattttcccacggtgattggagcagatacattcaccattcgtgcaagtgcatcatgccctcagatgtgccaagtcctcttcaattctattatatcatcagtaggataagtggcaaagccaggaatttaagcctgtggggtcaattactagtggtttgtatttaagtgaggtcatgtatctaaattcttttggattcatacatgaaaattaaggtttataggattttttttttcaaaaagctatgggtcagccaaccccacagaagaggcctaaatccgccactgaggcagatctaattgctagcagatttaactatttgccgtttaatttgatgtttaactacatgtgtcaataatttatgagccttcatatacctacaatatatagattcagtggtaaatagttatttgctacatccacgacgggcgaatagtctcatatttaaatatatcctaattgcttgcgatatcgactgcctggatgataagatttgaggaaagagaataaaagagagataaaactgggacacatacgaccaatgttgtcagtatccccatcgtaaaatggtatctta

SEQ ID NO: 109061 - DNA, 760 bp, Oryza sativa
atgcaaagaggtaagccacatatagctgcactactatgctgaaatattttgtttgacatttctgttgatgtgttaatatatgatggtattgtgaaattcttgatgtcatgcatccctgattacacttgatggtgattgacaggtgcggttgctttcattagaagtgtttccattgaagctgtggggcttggtgtacatttggcggcaggagctcatgatatgcttctaaagacagaaagtgcccttacagcaattccaccacctttagcctcacgtgaagcaaaaagaaccaaagacaatgtaagagctaaccagcctgaaagtgcgcaagaagggctgaagaaggtattgaattcatccaaattgcacatgaactcatcttttctgagatgaactcatctgttgtctgctaataacatgttgctttaacctaactatttgcaattctatttttgtttgtgatttgcgtttactttctatatcaatatggtaagtactgccagtataagtttcatttgctgtgtaattatcaataattcaatatatgctgaacatttttcaggcatatgaaagcttgaccgatgggtttggaaggactgcctctgctttgattggaaatcctattaaagtttataatcgtggggctggtgccggatcagctttggctactgcaatctgtggagctccaggtgctgcagtggctccattatcagcgtcttttcgtgctgcacattatacacttcttggtataaggaatagg

SEQ ID NO: 109062 - DNA, 533 bp, Oryza sativa
agcatatgcttcggcgaagataacgtcggccgaactccctccatcgaccaggattcgccggacttcaaagccggctatctcagctgagaataccagcggatcttgatgcgggaacatgactccttcggcatcttccggcccgaaagagatcagctggttcacatactgtggcgccccctcacccgccgaagtgatgctgtggaccgctcggatctgcatctttttctgccttttggataattggcctggcgggtcagccctcgtaatcacttgcattacccttcgctgcgcgtcttgacgttgttcgaccgggggtgtttgttcttgggctgcttcgtgaggtgcttctatagttgctccttgctgtggtctagtatcttgcgcgttgccacgttgcctgatgtttcggcattgctctgtggtatgcgaagagcgtccgtggaaggcacagtaaaggtcttttcggacctttttacgaaccggctgttgatggttgctcgcttgctgggcgtcgaactccttgcggagggctt

SEQ ID NO: 109063 - DNA, 693 bp, Oryza sativa
catgtctatataacagtcctgtttttttatgacgatgagtaatgcgacactctgatttgagtacatccaaactgtcattcaagagcttcatagacggtcgagcagttttgggccacttgctggaaccgtgccaatagagtaggctacgtatgagagtggacctgttgtgccgaaaaaacaaaggccgaacaagagaagacgaagcttaagcaggaaatggctgaaagacgaccgtcttttagaaagaagtagtacaaacaaaaaaaggagactgatgatattagaaattggtttagaattaattgggtcattggaacaatagttctagttgtgctccttctcatgaaattatttgaatcatattggaatcttatttctagatatcatttagccatgctaactcacaatatattccccaacttacaatatcaatatccatttttaactcgatgcataaagttgccatcgcaacaggagacaagtttgttgatttcggctgctggctgctcatctcatgctcctcagggccaagcctgattgtactatgtggtaccataagccttgcaagataggttctaggttcgctagaaaacaaatttgttaaccttcaaacaagttcaggtgcacatatccaaattttccagaacaaacacacaaacagacataaagatgacagaagatcatgctctgtcc

SEQ ID NO: 109064 - DNA, 537 bp, Oryza sativa
taagcatcccatggaatggcttgaactttaagaaacttgatgcagatatatctcttaattcattagaattgcggttacaactgagcagtatccaatggctcatggatgtgtgggattctctccaaagaagaaatctagtacatgaacagagttatgcccataataccgcagacatatctagatctgccagttcatatgtatcaagctcttcaaaatcaggttcaggttctgtgatagctagcagggaacatttgacagaggacacattttctcaactcaggcaagaaaaaacacaagagccttccctgactatgccatacttgattccggactggattccagtgcttatccatgaggatcacggtgaccctgattcagtttgtgatgaaaggtgtgttcctttttgtttttcatcttcctttcttttcatgaaagttcaatgatattcactgcacctttgcatactgcaatccttttgtacatatagacatttcatcaagagtatacttatgacagaactgtggacaaataaataat

SEQ ID NO: 109065 - DNA, 1167 bp, Oryza sativa
atttaactaagtttgtagacaaatatagtaatatttataaaaccaaattagttttattagatcaataattaagtatattttcttaatatatttattttgggttaaaaatattacagttttttttctacaaacttaattaaatttaaaatagtttgattttgatcaaagtcaaaacgacttataatctgaaacggtgaaacagagagagtactagcttgtgtgatgagatgtcatgtcatgagtaaacctcaggtggattcatgtgaaaaaactgagtgaaaaaaaaaaatccttttactttagtcctgtttggttcccaagaaggtttgggtgtttagctgcagcccaaaaatggtggagtattgttaattctacctaacggagactataacagattctactagacgttgacttttacttgggcaatttgtggtttttaagctaaactttgtcagtgcatcttccatactactattaattgggattacatcaggtgctttgtgcggtgatcatcctactcactttgaatttggacgtaaagaagattgacgaacaattttgcccctttcatcaaagggtatatatcacgagacaacatctttgtgaaggttttgttccagacttttccaatgtgaaaacacaggctgtcaggaaaggtgaacactgaacagcttccatttttcacatccacccaatatatatgatagacaagaaatcaaagactaacaagccatggaaggtccaaatgctgccagatgctgatcgagcatagtgttctcagatagaacgattcaaagcagaacatgccaattgaacgttggattctcagaaataccagttcaaagacacatacaaacacaacactaagcgtacatcaccccgtgtgataggaaagcgaaaaccagcaaaataacataaactgctggctctgaatttgacatgttctacatcaaggcactgcaatgccacagccatataaatagcagcaggatcaaaggtaccaactgctcaaactacacaggtataacgcttgtatattaccttgagacacagatctcagtcaatcctcctaccttatatcacagattctcaatcagcaatactaacagcatgtctggggagtggtcagttaagctcttcgactgctttggagatagcggaacctgt

SEQ ID NO: 109066 - DNA, 653 bp, Oryza sativa
tgaaatattttaaaaagtttatgaaacatgataaaaataaaagttgaaacatatcgctatcacatattgaaacaaccaatgttaatggattgaaacatatgtttttctttcatccaaatataatcatgtgatatcttgttgtaaagatttaattacaaagaatacaacggtgtgatcggatcgtagattagataattagtttaagagaaaaatcgttttgaaactagctaaaatgcatgcatgcatacatgaggtggagagagagagagaggagaaatagtagtaacagttagttttgtgaattttgtgaaacacgctaaagacacatattgaaacatgtccctatcatgtatgaaacaaaaagtgttaacgtattgaaacatatgattattttttatcaaaatataatcatgcgacatcttgttgtaaagatttaattacaacgaatacaacggtgtgatcggattatagattaaataagtaatttaagagaaaattcattttaaatatcgttaaaggtgcatgttatatggttagagatagagatataggcttggatatgtgtatgtgtgtcagaggatgctgtccgatttttctccttgcttcggacgttcgaggagaagaattatccacaactagtaatatacctgtgc

SEQ ID NO: 109067 - DNA, 1137 bp, Oryza sativa
acggaaacgcaatgggtgaagtaggctggaagaggacaacgacaacgcgcttggggtttcactgggagacgatgacaacgactccccctccttctctcccactctcccgctggcctcatttcccccttctcccgccggcgcgacaggtagcctctcccccttctctcgccagcacgggcggtgggctctcccttctctcaccggcgcggccagggcagtcggtgtcacgcccagaaatttagcccaaatttccagactattttgtgtattaaatccctgtccaggaccagccagggtacacaaaacgacaagtaataaacagttccaaacgtaaataaagcgtaaaatacttacaaaagaggcacttagtcctcacaccgaaacaaaagcagcagcagcggaaaaaaggcgatcctagcggggcttcagctccactccacaggcaaaactcaactggggtctgagccttggtcttctaacttcgtcttcagctcagaaacactacacttctgaaaagggggaataatagcaaggctgagtacaaccaccgtactcagcaagccacaccaatgatgcagacgtgcaaagggatacaaggacggtttgtggctatttgcataaaggcggttgtgaaagattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggtagtcccctctcgtgcctaggtgaatccggaagcgacagaggccgtcgcagggcccgccccgctccatcacgcccacccttgcctggatgcgtcgactagaggaaagctacactacaagccca

SEQ ID NO: 109068 - DNA, 631 bp, Oryza sativa
ccaatagttgctaactatacttgttggcggatggcatgaggcccttcgaccaaatttgccgaaacccgtggcgaaggctatgaaccaaggatgaggcgaggcgaagggtcgcgtgagtacctgacgaagaaggatgacttcgccatagccagttcgccctggcatccagcgaagaaggacggcttcgccatgtccagttcgcccccgcaagggccgaagaagcctttttggcccatcaagcttaggggctatagggccggcggtcgcctgacggcccatcaaggacccataagtccccttgacattatgtaaccctgtaaacgtctctttcataagggcaaccatgtaaattcccccgtataacctaaaccctattagtaagaacatgtaatggggctataaatagtcccctagggccatgtaatggggggatcccaagtaaaattaaaaatttaatacacttcgtttctttcccaaccactgttgagtaaccacgtctttcgacgtatgcggttgtcgtttcgacaacagctggcgccgaccgtggggacctccgagcgaaaccactaagagcgaatgccaccgaagaaggtcgcgaacgagatggttacaaggcgaaaggaaagcgaca

SEQ ID NO: 109069 - DNA, 600 bp, Oryza sativa
attttatttctagagattttgggggctctaaggctccgagctgttaagtgttgttctttggtgccggttggatagtgtacggacacctggtctaaggtttttaatattcatttgtaatattatgtttgtgtagaaaaaaaatacttgtggtgctatttattttgcatatatgtatctagtatgatctagtatatagtttgtggtttttcaggatggtaacttagttttagtaccatgcgatcactggatgtttaactgctggttatttgaattattatgcaagttcatctacattattccacctattaactctactacttatcattattcttattacttttcatgtatattattactttgttagaaactacgataattgttatgatttaacgatgacaccattgatccaatatcctagatccgcctctcctagtggttaggagctaacgaggatgggggctggtggggcggggtacctcaccgctactgacttgagaagagggggggggacatcgagtgagtagcgcttgatcccgattctcgtgcgacactggtgtgagggatgtggttaggtttatgtcgtactgcatgaatcttaaa

SEQ ID NO: 109070 - DNA, 626 bp, Oryza sativa
ttcgttttaaaaaaaatccaattctaaatttgaatctggacataaattcaggattgggtttttttttacggaggtagtacggtgaatcagggaagagaactgacggtgaatcggtgatcgtctcttgtatgcgtatatggcagcttccaagggttccctgagaagccgagagtgtgctattcgtcggagaagctggtgagggaagggttcgagttcaagtggacggatctggacgaggtatttgacgacctcatcgagtatggcaaggtcctggggattctaccgcaatgaaccgctgatgatgctccttcactttggagtttggactggtcactcttgtgtgaaatgaagtcattgtcgtggtgtgttagtacttgtcacgacacacggtatggcaagatacgataagtacttctattgttatgggctctactacaaataaggaagcgatggatcggccgcacaaattaggcccatcacaatgcaagcgtcatatcccgcacgattctgaatcacaccacgcgacgcgacgcccgcacgggcaacagcgacaccgcactccgcacgcaggcacccgcgatcgcaacggaaaccgccacaaaatgctggtcgcgatgagccccccc

SEQ ID NO: 109071 - DNA, 778 bp, Oryza sativa
attaattagaagctaataatccaattttatttgaaattaaattaattttcaaagaaaatcctcgaagatttttgaaaaagaaaaaaactaactgcgtacaatcacggttgctagctagcaacgtagttccaggatgatagtatgcttatatagcaaaaaaaaaaaaaattgacgaaaatccagcaggagaggctcctactaaaatgcattggcaatagtagatatttacaatcccaaaaagttctgagagggagaaaagaagaaagaagaaaatagaacttataagaacaaattacagattatctagtcatgatttctagggtggtctgtctgagctttaaccctatgcaaaagtagggtaaaaactatatagcgaaaatcaagaaaatgccattaaatttgtgaaaaaaaccacaaagatttaaatttgagcaagagaagtgttggcctctggttttgaacaccgaaaatgtcatgtgtttagctgtattaatccctggatcagtaacacattcataaccaagcaatacatacaatgaaatgaatttaggctaaaagagcgtaatgcctttacaagtaccactagggtcttgccctatcacataacaatagtggaaaacaaaaatatatataatattattttggaccatattttaaccatttgcatcatatctacaaagaaaatgggcagcatagattataatatcatatatcactttgcaaacatgtataactaaattagctctgcaatgcctgaaaacagagtttgcaccttata

SEQ ID NO: 109072 - DNA, 771 bp, Oryza sativa
attcctgcagccctgtataaaccaaaatgaatgttctttttatctatactaattcgagtgtaccatttagtcaaaatgttatcactatagtaatctctggttgccgttgtattcaccatattgtagtatcgaaattcttagtggtctcgaggggcatcatatttgtgtaatgtgaactcttcccaagacaatggaaacggtatttgttgattccagttcgcactctggtaggtgttcacactaactcgatcaaatgaaatgtacgcattagtactacaacaaactattattagcttttcaatctctggatgttgctagggctgtatcctagacaggttctgactaaaccattcaggttttagcccttggcatcttccaagccatttgctttcacatattcagaattgactgacattcatttattgttacaactaatttcggtgatcagctttcctggaaaatatttgctgaaaatatatgtatcagtaccaaaatgtcacatcttaattgctgaaaacatatgtacataaccaaatatatgtaacagaattgcatattttcagatattcacatatctactttattctgtcaatagctgaaaatatgggaaacatcgccaaaatctaattgagttgtcaccagcacatacattatccgtgtcaattagcaataccattcaatttaaagatttgtacagtacttgattaatgaaatcttgaagttacttgctcatatgaagtcactaaagttctgctattttgaactctttga

SEQ ID NO: 109073 - DNA, 1298 bp, Oryza sativa
ctaagcttggacaagttcacaagagctctcagattgcgatggttgtggaatgaatggagagatcctgagcaagccttgggtgggattggaaacgccttgtgatggtgtggatagggacctcttcgccgcctcaacaaagataacggtgggcaatgggaatacgacgcgcttctgggactccgcatggattgacggccaaagaccaaaagacctaatgccgttggtctatgagatctccaaaaataggaagaaatccctacgccaaaggaaagaagacgactcctaggtgcatgacctgaccctcgatgcggattcatctatcacaatcaaccttctcaatcagctagtctgcctgtgggaggcggtatggaatgtgcacttagacagcgaagagccggatcagattgtttggaaattcacaagcagcggccactatacagcttcctcggcttatcatgcccaatgtttgggggcgccaaacacaaacttcaactccctaatctggaaagtttgggcgtcggggaaatgtaaatttcatgcctggctcatcattcaaaatagagtctggacgtcggaccgactcgcgacaaggggttggcggaataacggacattgccccctatgtcgttgtgacgccgagacggccttgcacctcgtcgccatgtgtagatacacgaagagaatctagcaccttattgctacatgggcgggatatcagcagttggaaccggcccaatgggaggaagcccggtcagtccatcagtggtgggagagcctagctaatacacccggcattccaaaaaagggccttcggtcccttattcttctagtagtttgggaaatttggaaggagtgaaatcggcgaatctttgatcacaaagagatggcaacaggtgttctcctagcaaaaatcaaagaggaggccagcttgtggactttagatggggctaaaagattgcgcgaactcatcccgcactctgtatagtgtatagtctaaagatctttttgttttacccctaggggttgtattttctccttctattcaatgaaaaagcattgctgtgctgttttttccgttaaaaaaaaatctcttttcagggtttgctgagaatgtttacatagttgtaaatcttgtttggagtactacttctgtttacttttgtaaggtttgatcatagcattttgcttccgtttttatttttctgatgcagctccatcatacatcgattgcattattgaagtgtgatgaaaattatagttatcatgtggagaattttctatcatatatctttgaatga

SEQ ID NO: 109074 - DNA, 713 bp, Oryza sativa
acaacatctgtcatctttccaggcttgagggaaaaacatggaaagaattgcggtggggacattacagctcatccaaagttctcatcggagagttcgcttgattacagtaagtcggtaactgctaagaaaagatcaaaccgcatgtcaaaacaatcgaaaacaggatagagtttcttttattcccccttaaagtagcaattataaaaatctaccaagtatagtttctactgttcagcaaacaattaactaactcgattcatagcttgcattctgatatattcgctttgttcttgatccaaatctccaattgcaggaaaaggtgaaatgcgcttatggtaggaagtctctagctgtgtggaccaagcctaatattccaacccaccccaactctgattatctgatataatctgcctttctgtactatgcatttctttatgaactttctgtgcaaatgagaataacagttaagaatcaagtagaccacctgacctgacctgattatctgataacagtaagaatcaagtagaccacccacctagcatttctttatagatttggtcacatactctaatgtttgcttgcaaaatggcaaaaaaataaaaataaaaggtgtacacatatacatcatgtagtgctgcaatttgagacaactgacatgaatacagacttggatcaaatctgtgacgaaattgcagcactcaggatgctcttaa

SEQ ID NO: 109075 - DNA, 748 bp, Oryza sativa
tcctgcagcccttgtatacatgtacactctttatcaatttttgaaatgatttttctcctaacctatctatctgatctatgatctaattatatcgttatattcgttgtaattaaatttttataacaagatctcacatgagtatattacgttgagaaaaacatatgaaacatttttatactataaatgaaacaattgagttataagtactgaaacatcaaaagaacactattgcaatatttgcaaataaactagtgaaacatttgaaaaaacttattgaaacacctagattccggatttgcaacattcaataatccgtagcaacacaaaactttaaatgtgcaacaaagtcgaattaaaaattaagacatttatttctcacgcgtgaaacattcgattttaacggttgaaacatgtaaaaagataatgtacaacattgtacatgcactagtgaaacatcaataaatacttgttggaacattacattatcaatgcccaacatttaaaaagtaaaaaaaaagtcgtcgacatattgtcgtgtgatatcttgttacaaatatttaattgtaacgaatccaacaatataattagtttgaaattcggataaatagtttaatagaaaaaatcatttaaattttgaaacatactcgcatgtactctctcttagctaactggctatacacatgcgctaattgctcccttagatattttacgtacgattttttctttccggccgaattgaacggcgatg

SEQ ID NO: 109076 - DNA, 725 bp, Oryza sativa
tgcaatctctttgcttgagccgtaaggatgatggaacaattgatttcctttactctccgtacattttgatgttgtctaggccaatggttcagcgataagcaagcgaatcaatcgactaattaagtaattagctacactgatccatgcatacctggtgccaattggaaacctagcaaataaagttgtgtacttgtagaatctttccaataaataattatgtaagaataaccgtctgcagagccggagggcacgctgacatttgacggaccatgggtgcttttgaagtgttaggctaactagctctttggagtaaagatcaaccggtgcaagaaaaaggacaggttaattatgtttttgttgaataaagttgtttgcttttagtatggcatattgcaaatactattatgatagcattggctgctataaattaaagaagagtgtttttttttaggaaaaggacccatccaaagttaaaagatagttctcacctttcatcaccatctcaagtttttctgtgaactacttattccaggaaaaaaatatttgtgaactgttcaattaattgagttgatctgctacccaacacattgttagatagaattgtttctaatgttatactgttcaatacaagcatcaaagtagctagggagagttaaaacatttcacatataattactttgaattaattcaattcatcttgtatccccattaagattttttacatg

SEQ ID NO: 109077 - DNA, 1642 bp, Oryza sativa
ggtcacctatatttatgggtggaaatgggagagtggaaaaaatgaaaatgggatggtgactcattttttttatgatcctcctgcttgcacttttattccagagaacatcactatactttttttttcatcatgcttgagaaaatttgcttcattctcttttgagcagagttttttttagctcatgtctcatttggcatggatcattagaggagagaccatacaatgtttttagtctttatttggtggatgccgacttctggtgtaaagtttagcatatgaaagtgaatggaatgtgttgctaatcctacagtgcggagaaaaagcaaaatttttggtggctaagtgcacaagactttggtcatgagaatatgaaaataatctaacaagggtcacaaccatttagcaaaactcaaaatgatagcaagcagcatatgtataaggtttcgtcattaagattgacatatggctttggtaggaaaggaacaacattgaggagtatgcaaagttattttattttcctttataaattccaagggttcaacatcaagtgcaagtttcatatcattaggccatctctcattaatcaataacttagataacacgtggtcccatgagtatgtaagtcatagaaggtgtgtgcagggaatagaaggtatgcaagtcatttttacaagcaattcggagactctagttgatcatgtcaatactcattttaattgttgagttaattttagataaggcaaaattaatccaactcaagcaattaaggatatgaaggataaacgtgcaaaccaacgctcatatgtgagtgtgaagacgtgcagctctgtgcaatgggtgcttcgtctcatcttgtgaatgtgcaagcgtccgggtgtagcacagacatgggtatcttgtatgtgaatgcgtcatgtgagcacaagatcaccccacacttgttttcgtacctagggtgcttcaaaagacaaaaagacaaaagaaaaatgtaaaagcaaaatggaactcactcagtgaaacccgatgagtcttttattttggcatttcatccaggaggcaaaggcggccttgcagcaagctccagttgcccaaatccagaagatcggaaggcatagtaattttgtaacgcatggtcttgctctactcagcctatgcctgaaacaaagtgttgtttggctctcaggctcccaagtgtgtttctgaacgcctgtcctgagattgtaatccagtcgtcgtttaattaatatatttctttcccccgagaaaaacataaggagtaagaaaatgtttatgaaatacttactgtttggtacagctactgagagacacttatggaatgctttagaaaagtgaaatcacatatattggaagaagaaagataattttgtataaaggtactctggagatatgtaaggctaaatttgtgaataatgtttgtcttgagacccccaacatgtacatgtgtatggcgagcacaatatctccaacacagagaaactgctagagcagtacaccatatacatatatacccatctgtaatagacataatcaataagcttgattttttttcctttaaaacttcaagacgtttgatatactatatgactttttcttccatgtagttctacctctcacaatctcc

SEQ ID NO: 109078 - DNA, 526 bp, Oryza sativa
ggccccacctgtcggcgagagtagacgggcgggcccgcctgtcggcggctgcgcgggagggggaagggggaggccgagtgggccgcgggggaaggagagagagggggaggggaatgggccgaattcagcccagagagaggggaagggattttagggttttctttttagaaaaactattaaactttgtttatttcttgataattattatttgtgctctgaaaattccactaaaatttgattacgcattttaggctttgagaaaataaacaaaaattctccaagcctcatttgacttttaggtttacacattttattgttgaagactttaacaagaatttttcttattttaggaataatttaaggaatgcattttagggtcgttttgggacgtgacagcagcgacggagtgctggcagcacccgtggagccaggcaggcactgaggtgtggggcaacgcttgacatggtagctgttgacggtcgttatcgaccaatttcgaccgtcaatattaccgggctgcaggaat

SEQ ID NO: 109079 - DNA, 1061 bp, Oryza sativa
tctagcggagggccattctcggggtataacgttttactactattgttcgttcttcgtttcctgctagtgacagccacaatgtcattgcgttgtcttgtttatgttgacgcttattttatattaagcatactcatgttgtatacatttagcactgtcactagatccacttatattgcaaagtcatgtttattgtcttaatattttggattaaaatatgccaaattatgaccaaatttccaacagcgtcaaggggtgtttgcatgaccctaaacttcatatattagtagctgccaccacttttagggtttgggttttgcttagattaatctgtcagaacagattcgtcgatccttcggtttgtgagagccccaacttgtgagtttaatcattcatatataatttggttgtattcgtttttgttcttgtttgtgttcttcgattcgcaagcagggattagccttctcggtgaggtcaaccgggtttcgacacggttgataaccaaaggagacgtggtgctgcgattgcggggcttaagagcgtgtttgtttagaagttggatcgacttgtgtcgcgactccaccaaatcgactgtttatcagaacctttcggaagatcgggaacccttgtccacatcaataacaccaacccggactaaaaaatcgatctttagttctggttggtaacaccaacccgaactaaagatgcctctaagattagttcataaggaaagcatctatattctagtcagatgtgtgtagtaggtgtgatggttacacgcgtgagtgctaaggtgaaagatcataattatcctttcttactacataaacacactgttgtgttcggcatttgagcaagaacaatagtaggctacaagtctgctataagcatgtgtggaatagataagagaggatagagaaggaaatcaactataagcatgtgtggaagagataagagaggatagagaaggaaagcggagcaggtacaatagtaggctacaagtcagctataaacatgtgtggatgagataaaagaggatagagaaggaaaggggctgcagggat

SEQ ID NO: 109080 - DNA, 687 bp, Oryza sativa
aatgggagataaaccagcaattgaaaaaaatggttgggggacaatcagacaaagaatgaataattggaaaacaaattgatttcaagacattgatagtaatcatcaactttttaccactctggaggggtgagcggcaatagatttgccactttgtgggactggtggctgagagagggattaaacttaaactgttctagtaaaaaaggcaaaactagaacggattgggaagtgtcatacaaggataacaagtcacagattaatcattgtctgtggtggtagtagatgaggagttgtgatagacaaagctgatccattggacatttgaatcgccaccgagatgcacgaatgaggagcgccatgcctctaccccgatatgcgtgattgggtatcctcctgtgcacatcgagcccattgagtggcaccccgggggcatggggatggaagaagtaggaaaataatgagaagacggggcaataccatggccctgtcgctttgttgagaaatgctaatatgataattgatagagaaagacatttcaatcgaatggataatataatcttgatgatctggtctcatagaagttgagttttatagcagtaggtgtgtttgagaggagggaaaagaagaagattgagaagataaaaaaaaactaggtcagccgttagcgcataattaattgagtattaa

SEQ ID NO: 109081 - DNA, 818 bp, Oryza sativa
aattcctgcagccctcatttgtaacttgttgatagcaccctgtcaatatccagatttatataaggtagggtttaaagtttgaagaactgaaagtttcaattgatctctagaagggacaagtagtcctattgtcctgtagccatcagtccatcaaccatcacttagtaaaattgtaagcatactgtgacaccatcattgcttaattgttttgggggtatacattgttctattgtgcagtgtaagtctaacataataaaactatttaattgacaggttatggacaagtatctcaagaggaaagcgcccgatagttccaataatgtagctgtacgaaattcttgttcagaacaagatgacaatagttgggtgatgactacttaagtcatagtcttatttgctatgtggagaaagaagaaatgagaagagtaaccaacaaagctgtagttgaccgttttatgaacatgagaacacgagtatactaaaaggtaacacatttatttttatatttttacatgttcattggatataaatttttagttgaaattaatatgtttctaacttctgttctgcttttattgtaggctattacctatcgatgatattgagattgacagctttgaggccgaggatgtattttgcataaattgatcgtcttttatgtattttttgatgttcccctttgcggtttcttttcatcttatatttcggtaagcacttttacttgctactcaatgattttttgtgtcaatagttatctacaaatgaacaaataccattctttacagtaattgctgccatctatatagtaaagtagggca

SEQ ID NO: 109082 - DNA, 1116 bp, Oryza sativa
ttatattacaattaggagcaatggagagcacaaagagatatttagagagggacttagaggcgtggaggaccagcaagggcgtccaagtcaagatggaggtccaaatctagttgacttcgagtacgtttcaaagtccatgaccaatctgtactaaaacgggcgcccaggtcacatacgtgctcggattggggtgttctttatatggatggaaagctaagaagataacatttccaatggttccaatcccatatccaaattctttccgagtcatcgggaatcgaccgaacaagttgacttccaaattttgttccggtgctgtgtcaccgtattttggcctttgggccgtgtatcgtgttggagcccattagggttgcgtatgttagattaatgggctagacccaattaaatcctaataaattccattggtccacattaagtgctatgggtaataataccaccttggaaatctaagtgaagaggtctcaacttaaatatggagctagtggagagtctctgttgaccggttgagatggtgggcgaacagcaacacgcgcgcgccgggccgtggcgtgggcgtgggtgagacaaggctgctttctctctcgttttgtgtcacgtcccaaaacgactctaaaatacatcctctaaattatgcctagaataattaaaatccgtgtgaaagcctccaacaattaaaaggtgcaaagttaaaagtcaaataaggcttgggggatttttgtatatttcctaaaatgcgtaaataaattttagtggaattttcagagcacaaataataattattaagaaataaacaaagttaaaatgattttgtaaaaggaaaaactctaaaaagtcccatttccctccctctccctcttgggccggctcggcccatctccctccccctctctcctcttccccgcggcccatccggcctctccccgcgcgcgccgctaacgggcgggcccgcccgccaccctcgctgacgggtggggcccacccgtcatccccttcctcccgccgctcccgcaaccaccccgcagccctagcgctgccgtcgccgcggattccgccgcatcccgccgtccccgcgtgcaataaagtgggaagaatcac

SEQ ID NO: 109083 - DNA, 588 bp, Oryza sativa
  unsure (1)..(588): unsure at all n locations
attcctgcagccctgaaacagcatggctacatcactattgacgtggtatcaaatccccttcgttttggactgcaagaacgactggtcgtatagatcgtaaagcgtgaaactttttcagaagcaaagcttgtgatttgttagattgctactcgttaatcttggagatgcttacaaagcactagtatcttttagtacaaggtggcatggggccattgcaaaccacagatccatgcaaccctaatgagtactgactttttttttttgagggaaatgagtactgacttttaagtctgtgactaccactactggaaaattgatctttgctcggtcgccccaaaatcacaataatcccggtttaaaaccccatagccattctacgatcttctttagtcccggtttgtaataccaaccgggactaaagatgatcttggttcatcccctgtcagtccttgtcagaggggtggggatctttagtcccggntggtgtcacaaaccgggactaaagatcacgattggtattactaaccgggactaaaatcatgcatagtatataatccctattccctatcctatcctccacaaccggcc

SEQ ID NO: 109084 - DNA, 839 bp, Oryza sativa
ggtccaaggttagtgatggccattccactccaaggatcgccgagacgtctagcaaggggaaggacgtggtggtgactcccgacccggtctccaagaataagttgataggttcgccgggataacccgggaatctaggggcaacgacgagggtggcggcgtctgcgctaaggcctcaaaggcaccaggagtggtagcgaagacgatgtcaccccggtctgaccaagggaccgaggataggggtctgcaaggttcggcggtccaccaggttagttgtgatggtggtctcctcttgttcacttgtatgtaatggaatcgtcgtagactcgtggtgattaagcgtagagtgaatgtagcatgtcgtcaatgcgagatgatttgagccagctccagtcggcaaaggatgccgacagcgcctctacttaggccactctcgagtcgggtcaagagaccgccgcccgggtggatcggggctgccagagccggcacctccgggcccgaggtggccgggcagaccacaggggacctaggcgagctaggcggtgacatgacagcggcaacgacgaaggacgcgacggatcaagggaccgacgggggaattggcggtgggggctttgtgagctacaaacgagacatcgcatgcgcatatgcctcctcaccattctccgttgcgagcttctcccccgtgagcttctcctctgcgagtctcctccatggacttctcctccaccgagtcctcagccgcctccacaccactgacccgggaaggagccggttggcgaggatgaggaaatcgtggaagaaattccgcgtcggcagtgcgcgctgctgggctgcaggaa

SEQ ID NO: 109085 - DNA, 714 bp, Oryza sativa
attcctgcagcccgttctttcctctcagaaagaagttaagtagcacatgtcaagattttcacaaaatacataaatgtcctattttaatttcttacaaaggcatctaggtttatctgcaaaaaatatttgaaaattttatggtcaaattgttgctcatttactgtttctcttggttattagtaaacaaagtaaaaaccagccaagattttagtggactcacattaagactggcataaacctctaacagggaaaaatgagctaaaaataacaattttatactgacagttaatatttcttttgtaaatttggtattgtaacagtgactttagctttataacagtgaagttcattgatacaattagttaccatccagtgttcacgttttgtcgagtgataccattccatcatgttgtagtagcaatgtcaagtgtgaccattttcccttagaaactgatcccatctccactgaaacaagctcacctcctagatctagcctttaccttctttacgtccagccatctgtctgtacattgcattcactacatctattgcctagcctatcctcctgcaccttacccttatttctcacttatcctcccctatccatcccctcccttctgctctgcatcacaggcaggtgtggcatacagtagaaaccaataccttgtcagccactttgagctctgagcaccctactctggcatctatcttctc

SEQ ID NO: 109086 - DNA, 814 bp, Oryza sativa
cctattgcagtggacaatatcgttggaagctctacaccaaatccatttgcatgaacaggtgatacacaccaaatccccttggcctacccagtgacatgcactggaatcttagcaactgtctgatcgttattaattcaattcatcactcgcattctataactctgtaacatcatgacaacttgggctttgatgattggggagaccaatagttgtcttaatagaagaaaaatcaccatcaccactaaatccattttcattgcactcaggcgtgcacaaatgtatagagatatggctgcaagtgaagggagagatcaatttgttgtagtttaggcttcaagtacaacaaagcactgccttataatctattttggtgttcacatttcaggaatcatataaaagtattttaaattatgtataaaaagatcagattgtatgacggtagccactgtgctattattaaagatgtcaattcaaatataatttctctggaatttttcctatgctaaatgaattatctggaattagatccaaagtcttggagcaagaaacacaaggtttgcttctccagcagtgcactgcatcttatattggcactctagaaatacactgtgctgttttttttatagacctatacaaattgtcatcctaccatggtctatgaaactctatttttatctgtataatttgtatggagtgcagtgcatagaaaataccttatttattgttctattttcatatgtatatatattgcgaaaacgtgtcttgcacgtgcacgataactagttccgtataaacaactcagcgcagttacctt

SEQ ID NO: 109087 - DNA, 783 bp, Oryza sativa
gaggctcaacggatggcagcgtatgcacgggatgggcgactgattgagcccgtggtgtggcggcgaaagggaaaacgaagattggcgtggcgccgcagcaacgaagggaaggcagagaccgttacggtagtagcgaatgcatggatggaagcggctggcgggctacggtgctagagacggccagcgagattgagcgagggagaaggccgagtggttttaattgcggatggcgaaatctgagtgtaggtggcacgacatcgagggcaatatcaaggggagaaggaagagtgccatcgacgctagccgacagggaaccacgatcgccgtgatgggcaggcgaagggtagggatttcaccattgaggccatgtttagtttccaaaatttttttcccaaaaacatcacatcgaatctttggacacatgtatgaagtattaaatatagattaaaagaaaaactaattgcacagttagggaggaaatcatgagacgaatcttttgagcctaattagtccatgattagccataagtgctacagtaatccacatgtgctaatggcggattaattaggttcaaaagattcgtctcacggtttacaggcgagttatgaaattagttttctcattcatgtccaaaaaccctttccgacatccggtcaaacgtccgatgtgacacccgaaaattttcatttcgcgaactaaacaggccctgatttaacctattgaattggaaggggtaaactgaactactcctttttatactagtatagactagaaaaaataccc

SEQ ID NO: 109088 - DNA, 2153 bp, Oryza sativa
aacaaaaacaacaaatttgacaatgaacagaatgcgtaaatcgtggttaaatttgttatttttgtttcaaattgtaaaagtcgaattttaacttacatgtttgtggaaaggtatatcatatattgatctatcttaacatttctttttaaaatttgttgatgattttttaaatgaaatgcacaaaatgagagggtgccctctcgagggataaaaatccatctccacgagtggtctttatagtggccaaggacttgctatcgacatgccaaaattcacctttttaacattatcaactcttgttcctgggtgattgggagagaaaacacctcgttttctgtacgcacacttccgaaactactaaacggtgcgttttttaaaaaattttctatagaaaagttgttttaaaaaatcatattaatccattcttaaaatttaaaatagttaatactcaattaatcatgcgttaatggctcaccttattttgcgtatcttctcaatcttctcttttcctctcctctcaaacaatccctccgtggtgtgaaggtaatctcacttgaattagtataggctaccatttacacctgaacattagaaaccggaaatctattgggcaaatacttattttgcgggtgaacatttttttattaaatttcagacttcggtgtgtcctatggtcagaatgcagtaccttttagacttattcattctggattacaaactctggaaaacggttggagatacacagatattacccaacaagaaaaaccaggacattccatttatttctctactcctcctttcatatatatctatgttcgttattcttcaatttctttcatgtagatatttattctaaagcgatgttaatccattaaattatgcatgctacatattaagtcctataccaaactgtggagattatggataccccatatctacatgacagttataatttagtcggatatatggtaccaaatatagacagaatatctctataaggactcgggttagattctaaacttgtatgtcaagaaaatacccgggatcctagtcggttacgattgtattttatctataatcccatattccgttaggatatggacggtactttgtaaagtggactccttcccctatataaggagggtccatgtgcctctcaggacgcgattcttttttccaatttatacaatcaataatacactcggcggaatcatccccggacaggagtagggtattacttcttgaataagaaggcctgaacctgtataaaatcccttgtctctaaacccatccactttcctagcttgatagccacccccttttattattgtcgaaatcttgcttcgacacaaatgtccctgtgttttttgtggtgtttctttttgctatagtctggtgtggaaaatatggtgaaggaaaagaaaatgctagatttctttaaattaaaaaggtaggttttcttttgctatccagattcaacatttctcatggctcattattttacaagatgatcatcttttggtgtaataatatttgagttttttgcaattaaccggtttacactaaatttctattaactatggaaagaatggtaaaacttcacttagagcacgtggttgtgaacttgtcaggttcaaatccaaatcttattatccatttcagaaatcaatcacttgacatgtgaagtcacatttgttcaagctaccttttggcttatttagtcatttcactgtcgaagggaagccacatttgttcctttcttttgtaacatagccattcagtggatataaaaagctatataccattctagcttcattcttccctgttattttcggtttgacatattttagtccatgggttgttgacagagaattaagaaataatttctttagtttttttttgtttgttgaaggtgaaacaaaaagtcggcagaccttgctgtgtggcaaacgaatgaggttgtggggtcaagagagatgagcaatccatattgcttgatcctaattcgggcatgatggtggaggcggtgagaagttaagtagcgtgaaaagcatagtttctcaaacctttggtttgagacttttacttttattttgtatattgattctgatggcggatattttgctggctacctagcgaaattcaattgccac

SEQ ID NO: 109089 - DNA, 1760 bp, Oryza sativa
tcatgtcgcactaccatcgaggaagacgtggccaaccacgtgccaccctcaaggaagttgaggtagagctctcgccatgttgcccatgccatgctgaggacgagaggcgaagctattctatgccgtgtcgagcgttgggaacgagaggcggagctcgttactttacctccatcgcatcaacaacgagagagcacatctgttggggatgagatatggagagagaagatacggataggggagcaagaggaaacgatttttgtggtgagaaatgtctccaagagatgttgggcgttcgatatttggcttgctatggacactcgatatgaagcgtttctgcaatacaagtagtaagattagataaaactttttaaactttctatcgacttttgaggtcacgactacgatatttggatggtatggagatcttcgatatttggtgtctattctgatttgtgcatcttgtgtcttggcttgtcttggtttttgttggtttgtccatttcctcctagggtgcttgtatttatacccataggtgtccccttgtccaagtagactagggagaccaatatggatacgatccaaatagactagagttgccctcagcaatcggagttcggtacccttcctagcccctagctgtttttatggaaaagccattttccacaaagacagcttaaatcttataaccaagcaagctgaagctgacaaaatcctagcccctagccatgaagttgggaaaaccaattcccgattgcacggcttagttaatacgcattcagaatagagcaaaggaacgatatgatcgacttcgagacagggcgatataagaaaagaggatcaacggacaaatattgcatatacaaacacttacagaggttgtcggagaatccatctcttgaacccatctcgtggagaccttgaagcatcaaaatccccctagcgcgccactgtcgactttttaggttacgactatggtagttgcatggtatggacatcgttggtaccagggtatatgcaagattcaggtaaaagagatagagacaagggtttttatataggttcgggccccttatctgataggtaatagccctactcctgttggccgaagccggtgttgctcttattcatctgaatcacacaagtacaatatttgggataacctatctagctgtcgtcgacttggcggcatagataaccaacacgtagtcaacgacagggtagtcttccttctcgagtacgaactcaccgagatcagagatggcgcaaatccctcttgtcggcttccgcaggcaccatattgggtatgtctaggctcatctctgatgtcaatgtctagcggcgtgtgttggtttgttctggcttgtcttggcttagtccccctcctcttaggggttttgtatttatacccatagatgtccacttgtccaagtagaactagggacaccaatatagatacaatttgagtagtccttatcatttccacatagaattctacttgtccttccttatccggaactccttttatatacgaggtatgattccatataagacttagtatatggtgggtgatgaaccctaagttccactcgagactcaaggctgttgttggcccgatctttcggtgagttgagataactacgatttgggagacacgttgacggcccaactacaaccgtacaagacattgcgttgcgccttagcaatcgatacacctctccatgggttgttgatcttgccggtacaaatcaaccttattcctg

SEQ ID NO: 109090 - DNA, 939 bp, Oryza sativa
ctttccgctggcgccatgtctcaatccacaacggagtccgtcctaatccgggactaggccgcttcctagacgcactcgacggtgacgatggtgatgctggaggaagctgttgaggaggggatcctcccttctcgggatctcatcggctggcggggggccaccggggaggagttcccgaccctgaacaccgacgatatcatggtgttcctccccttctttaggtttggcctcggtcttcctgccgacgattttctccgagggctgcttcatttttacggtattgacatccaccatctcaattccaacttcatcctccaatcgccatctttatccatctatgtgaggcataatgcggtataaacccacacttcacgttctttcgttacctctatcaactcaagccatagccggggaagaagaaccccatggtggttggagggagcggcatccagatctggaccgagcggaaagcggagtttttcgatctcctgctcaggtctagcacaagggctggcactctaggtgtctactgctccaacttgttgcaggtctgcctccatataatggccatgccccgggcgtgaaggattgttggtacacactccctagccgcgatgagatggaccaagttagaggggtgctgaggggagtgcgtcttctaatcgatgctggcttgacctgcaacttcgtcacttggaggattcaaccactgaagagtcgtgttcacccagtctgggaatatttaggaaaggatgacccgaccagggagagcaatgagttgattgacaaggaccaggcttccgagaggttgaactagtttttcgagcccgagacgttggtcagcatggaagggtgctccaatcctttcaattgcagcaagaaatggccggaggtatgccctacccatgcctgcttcatatatatgtgtataaattggat

SEQ ID NO: 109091 - DNA, 694 bp, Oryza sativa
ggtgaaggaggggcattaccgggagagggagctctagggccagatttgttagctatggagggacggtgagttgctctggctgagagactttgtctttatgctagcctttttgatggtgtgtatatgttcgcagtcgaggatgagcgggagaggggcaaacgctaggcggcagagtggaagatgctggtggactaggctgaagcaactggcgggtgggcccagatcgtcgaactggaggcgtagttgcaggagtcctgacagggtgcgcaggatctacaagacaagttggatggtgagtcctgtaatgcgtgtttggtctgtttttgtactctgctattattgacgtgttttatcttgactgccacgcaagctgcaggtgattggcccacaccatcccgctgccccatcccgcacgcctccactcggtgccgcgtgctcctctcctgatcgacgtcttcttttctctccttttttttcgttttctaatttcccttttcttttctcgcgatcattctgtctcctccctctccttctaatctcctctacttcctcctcttttctcttttcctctcttttcttctttttttctcgatgtgtgaggctatgaaaagttgtaataagggattcttcatgtgatgacgaatgaagtgagcacagccgagttcaatattatatatgatttgggctgcaggaa

SEQ ID NO: 109092 - DNA, 689 bp, Oryza sativa
ttcctgcagcccagcttgtaatttttcttctactgtatcaatagaacttcgcaccgtcttgcatcttgtacgagttattcaaataaaagttcaagtccggaccacccaatgtcttaaaaaacagtccagaccattgaaatccctgctagctcattgcccgtcggtcactggaccagtagggatgtttagcatcattgccggttcatggcttattggcaggaaaattccctccaatgccatgaacctgcagtaagggttggctcacgttaaaccggtagtgatgaataggaagggattgctctttctgtacgagtgagtagccaaaacttaaaatcctaaatcactaatatatgaaaaactaataagatttgttttgtgaaaatagtatcagtgaattttatatgaaaagtactttaatgtagctatatttttcataaattgaatttaaaaaagaataattaaaaacatgtcgatgtcctacgataggtaaaaaagaaggaatggaatatcactcgctggacccttgaaagcagcagccggtagaattaaggagcaaggaaagaatctcaaaggtagggtgtgtgcgcatgtggagggtaaacctaacctaaggcaatatgcagccagtgtgtccactgacaagtgacaactgtagtctgtagagtagtaaagtgtagtagtgacagtgt

SEQ ID NO: 109093 - DNA, 630 bp, Oryza sativa
ggttttcataagtggtatggtgctctaagatttttatttttgttttagagagtgaggttgatttacatagttaatgaacagcttcacactcataccaccacagttcaacaaacatgcgcccttcctatctagctatgatgtgctcttcgatatcgctagttatctttcacgagatgtaagtatatatttgttcaaggatgaccaatgacgtccacgatctattatactctgtcaccaagcatcagacaatcctcacacaacaactctgatggttatcaaccgtaagcacaattgatttgactacgaagtattattcttacaaagaaatcggataaatatggaactatcggtataaaataagcacaactgatttatcataagagttaaatactccaatggttctgaaacttatcttcagatcatctcaaaactctaaaaaagcatatttagaccccctgaacttgctaaatttacaatcaaaggtcgaaaagctcagtttgaccatcctagtgccaatgtggcaggccaacacacagagacctgctgttggtccttaaacactagggcatcctccttgggcaagaaaactgtggatgagaatgagaaagagttgagaagcacatcagcaca

SEQ ID NO: 109094 - DNA, 551 bp, Oryza sativa
acatcacatatagttaaaaattaactaacttgttcaatgtcagtcgaaaaaagaacatttgatttacaaaaaaattaaaaaatcatagacatttaatttttcaaaaacataatgaaacagaagaaaaataataataacaagaaaatactaaacgtttatcatagtaaataactcaatatgctaggtcacgtttattatagttgatgaatcacacatagttaaaatttaactgactaaacatgaatatatatggtgcgctatatagtagtaaaaatttaactcgtgaatcaaagtgggtggagtcgggaggggagtggggtggtgtcacgcccagaaattcactagtaatttctgaactaatttgtgcataaaaccctcgtccaggaatcagccgaggtacacaaactgacaatttaatatacaaatccatcaaaataataacgttacatacttacaaaagaaaagaaaactgtagcggaattacggtctagcgaagctccggctccactcccacaggcagctcaactggggtataagccaaatatcttctc

SEQ ID NO: 109095 - DNA, 549 bp, Oryza sativa
gtaacttaggatagaaaatagtaacataagtatagaatctggcactcgtaattatattccaagttacaacaacctctaattcttcatgttgttttcagccagcacagtttcccaccaagcgactcgcatgagcttgttcaacttttgctaaatattataaaaatttattattcggggttatatgtgttctaataaattatatagcactttgcaaatttattcatagtaagtcatgtagtatatatactaacctaattttatgattcttaattataagatgtaagagggaatctttagtccaggcttaggctcttacaaacaaaaaaaatcatagagattaatccttcaaaatccaaatcctttgtttttactccaaaccgaataactccaaaagtttatcattgtttacatgtcctgcagctatagattaattacccaattttagagatgaatcatcaattgaagcttaaataatataacactatatatattctaaaacaaagcagtttcattaagaacaatccaacttaattcctttattaatttccc

SEQ ID NO: 109096 - DNA, 527 bp, Oryza sativa
  unsure (1)..(527): unsure at all n locations
catctcccaccactcatatagacaatcaagctcttcattggatggggcaagttgctaataggtggtccagtttgtcactagcccctggattgttagagtatctgtgagtgaaatgaatgttctattaccacatagtggctagtgaataatgtaaattcttttagaatttttttagagaacgacggtaggaagatctgnccnnntctaaattagtggaaaagggccgaaacccagcaaagagtttacagagtttacatggactataacaaagaggaaatacagcttaagaagaaaataaaatcagggggggcttaaaagctattttgcacaaatccatatcttgtttgataaggtatgctacttcatttactgagaggcaagaattttgaaaaattcttctgtttctttctagccaaatattccaccaaagtagttagtagtgtgcctctgataccctgcatttgaactttgcttcccacatggttggttccattccaccaagtttcaacatcatggggatggggtgt

SEQ ID NO: 109097 - DNA, 629 bp, Oryza sativa
ttcagtgcaggacctaaaatctctctttcgggttcagggcgtgccagttggtttgatcctgcaaccaacaagaaactaaactacagaatagcaaagttaaatccacaatagccgatcagccacatgccgatgacgtatcatttgtaggttagccaatataacgtgaattatatcggcaatgataaataaagcaaaaggaaagttagatctagtcgatcggctgtagatattagcaatatataatctatagatcgagatacatttaaaccaagtgactagtatggatcggaccaagtgctgagacaacatgaatcacttatgtctaaaagtactttaatataaagattatacgtgctcatagcatagccgatgttgtagacctaacacgtgtcggctaatactccaatacaactttatactaagatatcattatagaccaaatatattgaacaagaattaatcaagtgttaaagtagattaacagattaataataagcctaatatatttaataacagtgagatcttgatataaagggcagatttagcatgttaagtaaacatgaagtaaacaaaacaactaaatcagataagatcggctgaaacccccgatgaaaccctaatcggcaacc

SEQ ID NO: 109098 - DNA, 763 bp, Oryza sativa
  unsure (1)..(763): unsure at all n locations
gttgggcctgtgcctcctcaacgaccatttcgatggagaccgtacggacatggggcacatgcataaatgcattgcaaaagcttcaagttggcaaaagtaggaaaatcctgtacactgtactataaaccaatccatctgcattggtgacatttgtgaggctttgaacgggacaccgcgggagcacataaacaaagcaatatttcggcaatcattagttactccctccgttttctattatatgcgccgttgattattttagatatatttaacattcatcttattaaaaatatataattattatttattttattgtgacttatttattatcaaatgctttttaaacataatattatatttttatatttgcacgaaaattttaaataagacgaataatgaaaagtttgttaaaaaatcagcggtgtcatatattaaaaacggagggagtataatacttgtagaaaaacatcttactatagattttatatatgtgttgtccctataagtaaatcaaagaagcaaaattctccttttggaatatgacgtgctatctctgtgtgacacatgtgcgaatttgagccgtcaaccatctccatcgccaggcaccgaaaagggccaatntaattttaatgttctattacaccatatatatgcttctatcaacggtctttattgagtttttcctctgtcggaacaaaattatacaggaccttcgtcctttgcatatttggaaagaatttgcttctccactgccacgtgtccgcac

SEQ ID NO: 109099 - DNA, 724 bp, Oryza sativa
gaaaccgataccgtgttggttaaggttgctatcttgtaatcctgccccccatcctatataagggggcaggaggccctctagggggcatgagacaactagatcgtcagatctatattacacccggtggattcaaatctccaaacaggagtagggtattacctctcatcgagagggcctgaacctgtctaaatcctttgtctctgcatccatccacttttaggtctcgtgtgctacccctttttattattgccgaaatcatgtttcgacagttggcgcgccaggtaggggtgcgtcgagttatctacgagaagtgagatggaaccaattagaaggcgccgaatcagattcaatctagcaaggaaaatcaacctcagcaagttggatcactccaatctccgacgtcaccaatggtggtgaatcctcaagatgcagctcgccaagatgccggctggagctgctatacagtccgtagccaaaaaaaaatcatctgtatccaagagatcatcggccacgtctccagctaccagcctgcaaaaccctgcttgatcgtactgctctgcatggaggtcggccacgggagtcaccactgctatctggacaggcatgctggagcgatggatgttcacacgcaccggatagcaatcgagcctccgatccagtcgtcgtcgtcatcgccgttttctgttatgctcggtgagattattgctgagatcaaactggacgc

SEQ ID NO: 109100 - DNA, 726 bp, Oryza sativa
ttgttctgcattggtttcgatcttcaactagaggtaaaacttgttatggcggcttgcgttctcgggattagtgcttccatctttatgatactctaatcttgtttatgtaattcgtcgagttatcatatatcttatataatctctggcaatatcgttatctaaccaccaatcagctaacgtctgttactagaaagcagccgattaggttaaatatcgatgttgacttagattatataggatatctaccactctatgaaacatccaacggcttgattgtctagatattgtccttcttttcatacctatagctgcatcagttgagtttgatcttatgagtcgtgattagaatctcaatctctagcctgcttttggttgccgattaggatagcatcagggtttcagccgatctgacctgatttaactactttttctttatatgctcgattgacatgttaaatccgccctttatgttaagatcttgttgcatttaagtatattaggctttcgtttggtatattctgcttgctctaatatcttaatatagagtgatatcggagtattagccgatacatgctagatttatctgatcggctatgctatgaatatatatagtcttgttgttagtatatatttcgatctaagtgatttatactgtctcggcaaggcgatcgatctttcccaatcacttgatttaagtatatattgacataaggattatctacagcc

SEQ ID NO: 109101 - DNA, 672 bp, Oryza sativa
tgcacgcaagaaacacgtatgcatgcatgcatgcatccacggttttgacgaattccaccggatcgactccacgtacgcctatcgacgcgacgatcgatggttttgatgaatacctaggtagctagtatatatgcaaaactaaacgtaccaaacatattaaccgcatatgagaagtctagatatacggaagaaatatattgatcggtagccgaccgctgggaacccaacaacgtcttgcgttttatcacttctttcatccaatcatttgataaaataggacccattttgtcatctttattgggccgcctcaacagccgatggaagccacggtgcgagttgttacttaattttgttaagactatagatggccaaatgagtcgcctggcatggcccagccctggcaggaccaaggcatggcctgtgattggttgggttggcacaaccgaattgacatgccgtcccgtgtctgcgttgctagctagggccacccacatttttcccacccactttgcctcgaacgggggatcacaacaactcgcttgaaaacacgcatgcatgcatccacggttttgacgaatttcaccgaatcgactccacatacgcctactgatgcgaagattgatggttttgatgaatgcctacgcagctactatatatgcaaaggtaagtgta

SEQ ID NO: 109102 - DNA, 785 bp, Oryza sativa
tttttgcatgaaaagcacacagacactttctgtcaatcgtatatgtgtagatagttatatacttatatattactcccccggtttacaatttgttgtcacttttgatcgcattatttgcacacaaatacttgccgagtcatgcttcctgatacatgttttcctattttcccatattaataacccttattactattttctccaccactggctattttgtggtctagaattatacgtttaaatttttttgaagggtaatatatattatattttcacatgaaaacaaatgtacgtagatatacatgctatggttaaaagtgacaagatataacgaagtagcctgatgaatcctgtttttcttgacttgaccaaatgttttgagcactcctctttaaaagttcttcctttatataattatatgtgatttccacctagtggccagcagcagcgaaaatgctccaatgtgggcgcccgatctgaccccaaaaatcggacccttgcacccgcacgagccaattgtttttttttttttttttttttttttgagaaagaggaggcagagccctctcccattttcattaaagaaaacgattacaaggtccataaaatctgttaactttgatcatcttataaacaaacacaaaacacctacaagaatccttagttcttcaaaaaaagctagtaaaactttctcacatctatttatctattatattaataagacagctcaaaaaaagacaccacgtttatcgtggaggctagaaattctcacgttaatcgaaaaaaat

SEQ ID NO: 109103 - DNA, 899 bp, Oryza sativa
tatataaaagcgtctctatatttttgtagagatgcaatttacacgtctctagcaacgtcttaaataatataggtacgctttaaaaagcgtctccataattttaagacggtgcaaacagagacgatcctacgacgctttataaaagcgtctcagttatctgtgggagacgaaataaaacgtctctatcttacaaataagatgtctcctttgggttgttttgtgggttgttttgttgtagtggttctctacgcgtaggtgtcctccaatcacccggtcgaccgccctagctccggcgagctcgcaaaccctaaccggccgccattgctgacgtcagcatgacgtcatcatctcctttcccttttctttttctcgattttctaatagattaaaacttcagaaaatcataactaaataaccgtagatctgtttcaggtggttcaagtttctaaattcttctaaaatcaagatctacatgttaaaaatatccacatgtactgtttatgcttgtttttgtactgttttgttgatttttgtttaattgctttagtttccgacgttccggaggaaagcgtttctgttgaggaaggttccgaagcgtttgtggaagcccaaggcaagtcagacagatcccaaacaaccctttgagcatgttgatcccgtttaaagctattattttatttcaactatgcattgttttcgaatgtcatcgggtggtgaacctttcccaattaattaatggccgaagatgactttattttcctatgggttataatttgattagcatgaaccttatatattggattggttcagctaaatgctatatgtatgtttgcttagccatgcttagaaacattagttaactaaaggggttaaatataaatctatattacaaaattatt

SEQ ID NO: 109104 - DNA, 565 bp, Oryza sativa
gatcccccggtgttttttgcaatgaacaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagtcgtccgcgccgtttatctttttccgctgcttagatctttattgattgagaggaactatctacctctgtaatgatattttatacgcttaataattagagtaataactatactctattatcaatttgttattgtgtgcctcggctgattcctggacgagggtttacacacatgtaagcgtttggaattttggatagaaattccgggcgtgacaagttggtatcagagcccccttgaccctaggcttatgccaaatggttacccatagaagccctctaaaaatattggaaaagtagaactgttctcctccctttctcttttaattaaaccaaactaatggcacatgcatttcataatctcttttaatgg

SEQ ID NO: 109105 - DNA, 588 bp, Oryza sativa
  unsure (1)..(588): unsure at all n locations
cgacgactttgccatcctcgcaagagcagcagctgctgctgctcctcgctacactgtgctagacttctagtgcaccaccacttgggctgctgctgacgccnntcatctcgtccngcttagctgtcaggaangctagcccgattatggggcatcnatgcngaggacctnttgacataaaacgtggtttaaaatttttttcttccatatttactacccttcatttttgggttgggatgaacccctggctttttaaaaatttaaacttaccccggtgtcttttaaaaaaaaaccggggggggttctttttttttttaaaccccctttttttggaactttttttttttttttttttttaatccccgagtttgggggccccacaattgggggttttttttccccccgggggtttttaaaagggcgggggggaaccattttcccccaaaaaaatttttttttggggaaaaaaatattttctttctttttttcgggccccccaccaaaaaaaaggggggnggggggggggggcgccccccttttttttttttattaaaaaaaaaaaaaaaaaaaaattttttttttttttttttt

SEQ ID NO: 109106 - DNA, 906 bp, Oryza sativa
aaatatatattaataataagatcatacatattcatagcatagctgatcaaatagatctggcatttatcggctaatactccgacactactttatattaagatattaaagcaaatagaatatactaaactgtcacgtcctgataaattcatcccaaaataaaaatcatcttctaaaaggaataatagaattaattaaaattcgaaaagaaattggcaaacattaaaatacgtacaagaaaaattcaaatgtgacccggagaatttttgttaaattctccttggtctaaaaggagccctcaaattttagtggaattttcagagcacaaataataattgaaaagaaataaacaaagtgaaaaggttttataaaaagaaaatcctaaaagaagtctgtttcccccccttttttccctcttgggccggctcggcccattccctccctctccctctctctctctctcctcccccgcggcccatcggcctcccccgtgcgcgcgccgctgacaggcgggcccgcccgccgctctcgctgacgggtggggcccacctgtcatccccaaccccgcgccgcgcccgccgccgcgtccgtgccctagcgccgccgccgccgcgaatcccgccgctcccgtccaccccgcgtgcaatcaagaggggggaattaatccccgcgttcccctcccccgtttccccctctttcccctctctctctccctcggattcgttcgaatcaagcccgtaatcatcgccggcgcaatcaatggcggccgaaatctccgcggccggtttccttcctccccggccgccttctctcccttccgacgctataaaaacgttgcccgagctccgctctttcgtttccgccgctcgccgctcactctcgccgtcgaaatcgtgctcgcgccgtgct

SEQ ID NO: 109107 - DNA, 1242 bp, Oryza sativa
aggaaaaaaataaaatatctaaccattgattttcatttaatctgggggacccatattttccaaccattacatctaactaaaaaaataccaaatagatttatatttagaaagcaccacgttctatatcgatccatccgtacgtgtacgtgcatgtacgtatataattcgtacgtacgtgtccccccttcccttcttttcttttttttctttttttcactcatgagagataaaaaccaaattaataatttcagctaatagttgtaaaaaaatacaatgttatttcaagttgtattctacgcacaagtccattaaacttcctacgaatgcactttagtcaccacgtgacatcctatatactctcctaagctgtcatgtcgcactctaataaattagaaaaaatctttgaaattatgagaaaaaagaaaaaaaaatctgaccatccgttataacttataaaccgatgaatctattatttcgaacaattagatatatctcaatgaatctattatttctaacaattagatatatctcaaggatctgttttcaataaaaaagaaatctcctctctctatatatacgtactcctctctctgtggtaagtacgtgaatttcctactttattgctagcaaccccatataaaatcttaagttactaaattatactcactctgtccctaaatatttaacaacgttgatttttttaaatatgtttgaccgttcgtcttattcaaaaatttttatgaaatatgtaaaactatatatatacatagaattcaaatgataggaaaagaattaataattacttaaatttttttaataagacgaatggtcaaagatgacttaaaaaaggtcaacggcgtcaaacattttgaaatggagggagtataataaaccataaagatgcagagaaatcaaaacgttgaatatgttttcaacgtgcgtgctgcttgctttaatgtggttatccaaatagactaacctattcttgctagggattatcaatgcaattagcattaggtctgctacaaatgagggtgtgcacatgttttcatcctgctaagctctactagatttatcttaatcatcaatttgcgaacatatttaaatttagatccatggtgtctttaaaatacttaatgattcaaccgtggtaaacttctacggaaaagaataatttctagggcatgtcatcccaattaccatttaaaaataaaaaaaattatatactaaagggggctgcag

SEQ ID NO: 109108 - DNA, 672 bp, Oryza sativa
aaagctgtgccatgaaaacatcatgtgtgcagcgttggagtagtagggcttcttacaagtaaccaaccacagcattgttggcggttcttaaatgccgattctataccaccaacatctgcttaaagatcagacaataaaacatccaacatagtgataggtgcttaatctcacgtatttcacaagtgttgatatatatttgtatgcagatgataaactctgatgttgggaggaaatctagactaaagtgaggagaattctgtatccatacaaggatgggctgtgaacttcatcgaaacatcaataaattagcccaaaataccaaaaaatggataaaggagaaccaggggaggacatgggccaaaggccaggccagatggacctagcgagcttgtgaatcctctctatcctggactatcatttgcttggtgtccttggatgaaccaaaggaacctctcatcacacatgttcccttggattcgatacccttggaatactccgtaggggaagtgctacattggtatatccatgcgcttgcggattttatctgtaactattcaaatactaacaggcatggtgcacacgctgctgcacgagcatcatgatgcttgggtgaccagccatgtgcctgaaccgtgcggcgaagacataatgcacacaacatcaaagaagctg

SEQ ID NO: 109109 - DNA, 657 bp, Oryza sativa
cggaacgcctctctctccgtgcgccaatgagtttcgctgcccttcctatctctggccggccacgctagccgccgtgggcttcctcccaaccactaactcctctctattttcctccgtaggtgcaaccgccgcccgtctgcccctccgctcgtcgggtcgtcgccgccgccttcatccttcgcgccggccgccgtgcccgccggtgaaaactccttctcctccctctttccctctctcctgtgtgcgccgctgtcctccgcatgcgtggcgtcgccttcggccgccaccgctgcttttcgcaccacccaccgccgcttctcgcgccggttgccgtcgccggcaaccacccgccaccaccgcatcgccatcatcgggcggccgacttgaagccgagccgagcaaagccggtgccacctcctcactcatgagccactgcccagtgggccctgtctaccagtacccactacctcacccttgtgcctctgacccgtgggtcccgcacgtcggcgccgcccccctccttgatgatgtcagccttgggatgagttattgcgctataaattgattaagggttattcttttataagaaaaacacagataatcgttctaaaatgcatatctaattcatgccagctccgattacagccattcaagtct

SEQ ID NO: 109110 - DNA, 1847 bp, Oryza sativa
ctccggtgctaggtacttcggctattcgatgcaagggtcaaccactctaactataagttatacttcccaagagaaccaatttatcccgcttgacatgctttgacgtcttcccgaatgacgttgctgctggacttgttattgtctgatcgtgatcctgccagatctgaagcttcgttgttagaggtgattttaatctgacctttgtagactatcttcgaacatatcactggttctataactgggaatggctctcacgaacaagcagctcggattcactttctttacattcagtttacttcccattattatcttcaggttgtcctcagttagcattcaacgtattcctttacacctttaaacttgacgtgttctttcccattggatcatctcccaggacatggcgttgcctggtaaccggtgcttgcatttttcactccgtgtagcatctgataccgagtggaagatttcactctttgccttcatagaaacacttttacctaggtcatcttgcttacttaatgacaaggtgactgttgcggggcaattacactcaggggtcttccgtgagcgatgcagagcatgtttctgtttatcaatcacctttcggcctacttctttcatgctagagaacatctttgccaatctcttttatcaatcttctttcggcttatctctaacaggtggtattctttaatgtggattgcggacgcttctggggatgatgaggtcctttggcttgctgcctttcagtgaaaccttgatgtggttcgtcaaaagctgcactgactaccttcagggaaatacattgcctgctatctgtatctataccactagggtttaattgccatcagccgatggtcatctttagtgcttcctcgagatggggagcatccaaattgttcttctgccacatcacctttgacctttttctgataccagataaactaattaccaaccatcgactattatgttctcaaatattgatgtctcctggatcttcttaactgttggcaggtatatccgatcttatcaatgtagaggcatggcgggtacccttaggggtttcctccaacaatccttatcttgatctgtaaaaggcgtatccaaactcctatcctcaactactgtctcgttggctttttaacccaacacagtttaattgtttttcttttccatccacaggttggttattaactcggggttagaatatagttcctctgacacgagaccctaggtctcctttgtcagtaaacaattatacacatgatcacatatccgcatctttcaaacgaatcctcatggaacttgtctgtattacacatttctcccttattacatgaattcgaggcactgccttaaacaaaaagggacggtgcttaacatcggtacattgtatcctcaacaggaatcatccataaacatagcaagctcactgttttatagacatgaatatatttttttattacatgattgctgtagactcccggttacagtgataagtagctaactgaaaatcacaaacatggatactcattctgattctggagagatatagctggcgtggttctagtgactgcattatccttgattggttctgtgatgatgtgataggactgcatattgctatcattcacaggagaagcttccttctgattgctggttgaagcggatgacggtcttctgcttggtatcgccctttgcttggcctggagtaggtcggggagagacacaacttcttccatcgacgacaattctttgctggggctgaaagtgagcattgaccccttgtggtaatgcactcgctggagttggagctggtgcaacgcgagccataggactgctttggg

SEQ ID NO: 109111 - DNA, 681 bp, Oryza sativa
ttcctgcagccacctaacttaaaatatatctcaataccaccggttagtccacaattagcacttgtcattaattaccaaaattaacaacggaggcctagatgcttcactgtcaaggaggacgaggctggcaaggaccaaatccatcgtcactatcaccatcttcgtctgccgaagagactaaagaggggcttggagaaaaaggggagaaatatgaggaagaagaaagggttacagaggctgacatatgggtcccactatcataaactcagaatagtgagggtgaatggagaggctattggagtaaacaataagtttaacttgcaaaattagatagagagttagccaaataaatatttagagtcaaatttggagagactgttggagagtagtattggctcacatggcacattaaccatgatagggtgaatgaagaggctattggagtaaacaacgaatttgacttgccaaattagatagagagttggccaaataggcattttgagagtggtattacttgacgtagcacattgaccatggtcaaaagcactaagtcagccaaaaagttaggaatatttcgtggaaccgacatatgtcatcctcactctccctcacttggtcatccttctctctcctgtctctctcctccctttttccctttggcagtgacgagggagcttgggc

SEQ ID NO: 109112 - DNA, 739 bp, Oryza sativa
gtagtagatccatggccagctaaacttttaaacgctactcgaaactgaaacctgtcaatgaaaatgcagggtaagttaaaagtttgagcatcatctgcagcaattacaatgttcagttacttgaaaaaaaattaaatactagagcataccacacaatgagttaatttcagaaatcccatgctcagcaatttgtttcatataacccaatggtttaaaggcttttttttttaaaaaaaaaacagcatatctatgaatgtgcatgtgtattactcctacatataaacaagataactcaaggaggtgaccaaatgcaaaatcaactaacatactactatgaaggtaagcacttcactggccattcatgtgaatgcagttagcctgagtatatgaggtaagccaccaaaaaagattggacaaaaaaaaatattaaaagcagaaagacagacaatccttctattgttcaaactaataatcaacgagccaattatcagaacaagtcaaatattttaaactatttgacagatcaatatgtaaatgcacttcatgataagtaaacctcatatagctttaggcgtaccatctgccaacataatggaatagaatgatttccccactcccaccaaatacagtgcaggattttcaatagcttttcaatagaactcctatatcttgattttctatcaaatcaggaatgcaactagctttgggggatcccctagttatataaagaccgcccccc

SEQ ID NO: 109113 - DNA, 712 bp, Oryza sativa
agtgcattcctcctatcaaccaacaattgagtttcatgtgccttttgtattgcatgtatgcaatcatggtcatatggtttctctgaatccttgaatcccagtgtcattgcacttttcaaatttcaaaacttcagttcaaataagcaaaagatcagataatttggtttctagtttctactgctacagtgcttcaagcatacaaaaacagaggtcagaggttacatgggatcactaggccaagagtgatgtactgcgaccaacaatttttcttttatgaataaaaatgcttttaagactgccaatcaagaatattgtgatcaagagttataaatattgatatataagctccatgaattagaagttataaagttggggcgtttactacttatttgctattgaaatggtatctttgagttatatgggtcatttactacatatgattctttttttctggcccaatttggtttggcacattggagctgctctgggagaagcatgctagaaaatgcggacttacttgtgttgggataatttggctcatggaatcatctatttgattatacattaaccatgtgttttttggtcttaaacaagtctgaaaaggctcgacaagaaatgcattcttggttcaagaatggtatattcatggtacaagaatccgtcaatcctaacccaagagcatatgattagtttaaaaaaatgatgtatacta

SEQ ID NO: 109114 - DNA, 1244 bp, Oryza sativa
cgtccttcaacagcaggaaaccaaccatgtgcaagaaatgggaagaagaagaagatgaacagcagacaggtcgggtagctctgaccagctgctgcagtttcgtgtatatggggctggtggccggcgccaccgggaccaacaccatcgagcaatggcggttggctcggactaggtgctgcggcatccagatccgatgagcctgaacccaacgccatctttggcacagccgactcgagccagcctgtcccaatcggcaaccccttgcactgaacttgcagcaagaattgagagaaagaagatgtacaggagagatggaaggacaccaaggaagaagaagagggcattttggtctaagaattttgttaaacacattgaaggggtatgtagtggtatattttcaatacctggaaaattgtaatggcatagctcttaatagttgaatggtaatggcatatgtcagaactgaaaaaatgctgtgaaagggtatatagcggcatatctctaacacttgtaaaattgtaatggcatgatttcaaatagatgaataataatggtatatttccaaactgcgaaatttacagtggcatagatccaattaacccaccatatatattccacaattccaaatgttcattccataagttttaacttcagtacatgtctagtatttcgaacaggtcacttgtttaaccgtttactgatgtgtatacaaatttgtaattctagacagtttatctattctcttgactggtactgttgtatcagcctttattaatagatcgcataactggatgccgccagcaccaatgttctgtcagacagggtaaaaaatatatcacatgattacagccatacggagtatatatttttatttaaacaagtacaactcttttttactgcatacctggctttcagtgtagggatccgaaaatgttatcactttgaactgcagtatatcctcaaatatggtgggtactggataggttcatctcatatagccttggagatctagataacatagatcattctggagttaattactccccggcattcttcttgaaattgatgatatatttcctaaacttttgtgtgtgtgtgtgcgggaacttcaaaggactcaacgagctgaaacagttgattgaagaacctttgtaccgatactttgattcatatgcgacagagtttaataatgcttacattttatcgtatggacattttctcgtgcaatatgtatgctcattatt

SEQ ID NO: 109115 - DNA, 1409 bp, Oryza sativa
ttcctgcagcccatgccattgaaaacgaagctagagatccattatggaacagcaatgccagatcaacgagaattataaatttggatcatgttgtttcagaggaatcccaattgcgatacaaatcagacacaagtatttcgggcgggacctgtgctttggaagagcgtgtgtggagctgatcagtatattgggtatttagatgttctaattcattgactcttttggttcgatctcccttggttataacgaaacattcttttttttttacttttggcatagaaagataatttgcgccaaaattgaaggatacaacattatggctactcccaaggatgtggttaaagttgaaaaaggttaattttattggttattcctgagaacatgaaagatttgtattttatttatgtagcctaaaaaggtaaatctgaatttctaatttaatgtggtactgcaatccaccatttgatttatatagctagccatgctaaaaaaaactgccataattgtctctgcagctacaagtatatgcagatacgctgggatggagtgagcataatggaagaacaataggcctttatttgatggcttttagctttaagatgctcaatgaggagggccaaggagattttgttcttttatttgccattgattggccttcggttgatatatctgagttcatgtactccacaggcacgaaaaaaaggtaatatccatatatgcaggattatttctttactttaggtttttactattttactatgattagacaaggataaatggatatattttatagtatgaacctattagataagctcagcttagtgtatgcagaggtacaagcatgaaacaactgattctgaataggaattactactccccttttctagtctacgaatttgagtgggtaccttttcattagcaaggcttaaatgctcccaactggtagttgtttatgaattgatagaattttggtgatttttggtgaaatatattctccaaagaggtaaaccttattttagataaagaagatattttattttgaagcagaagatgtgctatatccccaacctctacgccaggggcacgcgacacgaccaaaacacattccatgatgctctataagtctataactactacaacatacataatttcatttttatatcgagcactactatagcatacataattttcatttttatatcggcattgatctaggattatcctgccattgctcacaagctactaacaggtagtctttttattttcttctttgcaagaggaggcaaccttaatatatacctggtggcacctctgaccacaggtttggaggatggaattaggcacaatgtgatgcatatgacttcagtggagcaattttatcaggattgctggtttggaggatggcatta

SEQ ID NO: 109116 - DNA, 792 bp, Oryza sativa
gtaacttggttctacgcgccatatcccatcaaatatccaaccacattcttcacatacaaaacactgtaaatagaaaatttcagcactacagtgtttccttcacagcagagctgatatttttgtcacaactttcatttcctatttgttcaggggtgaatggattgagatcattaataaaaacaaaattagatgtaactaaaatacctactagttgatgaggacatcaataccacgatacatccacgtctacacaagtacaacttcatggtcttattaccctcactcgtaaacgtcaactcaactatcatgtgagttcattcgtgacttcatgttcatcttatttgtaccctagagacgtgtgcactcttgttttacataggaatgatggagaggatcaaaatgggagaggatttacgcaggctagatttgagatgcagactccggtttgggcacgcagatacttcatggaaagtttatcaagtctacttttaaatggatccgtcctcatgtccatatttgttctagagagaccacaatcattgttttactacatagatctttttctgtccatggtgctgcatcaccttatttgggcccatgggctgtgtatcaactcgagtccattaggggcgtatcttagggttggaagacgaccccaactcgtcctcccacctatatatttcccttatccgccatagatcaactcgggttttgtttagatcaaagtttagcttcgctattctgccgtgtaatcctgtgatcggttagatcgtcggtttgctcattacggaa

SEQ ID NO: 109117 - DNA, 656 bp, Oryza sativa
atacacgaaattaggagaaccaaataatttcatttatgcctgttttgatgagtttttctagttctcagtcctatccttcacttgccatcaaacccagcagcagtggcggctatgacgacaagacatgaatataaacaacaagtgaaatcctaggcagcggtggacacaaactatggtggcatgctatgtgtataaggtgctcatgtggataattagatggctaaatgattcacttaactcaaattagtgacctagatttgcattttgaaagtagagtaacctatatgacacaactaaataagtcggatgaccctccatgcacttatctttattatgtctgaaaagaacataacgaaacaataatacaaattcatgaccaaacaagtctatatatggaaaactatgtgttacacattttttaaaaaaggaacaatttactgtaacaaatgctttcataactgaacttatcacactttaaaaaaacatgagcctagttcagaatttagaacctcaagctgcaattagaactaacgatgaaatgttagaataaaaggtgctatatcatattaagtgtgccatgtacagatatactccatcatacaagtacatagtttatttcagattgagatgaccaaatgtatacagcattcatgatc

SEQ ID NO: 109118 - DNA, 720 bp, Oryza sativa
gcgcatcggcctcggggccgcttgcgcgtgcccgaccgccttggcgcgtcgtcgcccgtccgacgccctcagaccgccgccgccgcacaaatcttgacgacgacaaagccaggacgacgacagccgcaagaaatcgccgctcgacgccatgcgcgcccgtccaaagccgccgcgaagtccgattttgattctacccatggtgaatcacgccaattcttgccgcacggttggattgaagatagacggtggtatcccctctcacaattcaaaccattcacccccgagtcggccgttttcaccctcgccgccactgcgcatcgcgcccggattggcgccaacacgtcgccagccgatttcgcacgcggtcaagccaatccttcgctggtaagtattcaaacgtggcctcccgccactcaaattgatcttgcccgtcctctcacagcctctgccgccccagccatatccaatccttgagctcatccatggcgatgacggtgtccgagctcatccgttcctcctagccctataaataggaccccaatcccttccttgtccatcatcgatcatcaacaaccatagccccacaaccccgagctttgattcaccaatcgcccgtcggtcgaacaccttgtgcgcgatcgactccacatccctccatccatcttccgccctaaataccccttagaacaccttatatcaactatgttatagtatattaga

SEQ ID NO: 109119 - DNA, 670 bp, Oryza sativa
aaaatcaactgcaaaaacaacagcctctccttgaagcctgcattaaacacttaatttcccatggcttgctgagtactcccgtactcacccttgctctatataaataatccccccccagttgctgaagaagacgaagcagatcccgctgatgaggagttcttccaggagcaagccggttacgatgagttttagggtttcggcctagttcccaagtcgcgcctgtgatgtttggtcctagtcctggcttccgctttccttttgtaatgcagttgtgagctcggggtctgtccgtagcccaatatgactgtacctctactctataataaagagacctctgttgctgtgataatctgtcttcctgtgataccagcactgtttcctgggactagtatcgattaacaggttaatttggagcgtcacgggctagttccggtcggtactagttcggggcgtgacactaactaaccaaattagcgtttaccattttcaataccacaatgaaatctatctatctattataggaatgtaactgaaattcggaattaaaaacaagaaatattgatagaagagtacatataagaagccaatatgagattaattaaaattcagaataaaaataaaataaaatccacaactagaatagaaataaaagaaaagttcacataggaat

SEQ ID NO: 109120 - DNA, 620 bp, Oryza sativa
aaatatgcagcaataaagatgaagagccggcaaaaagaaagtcttgaaaaaatgtctcaaatcaaactttaaagctctgaacatcaatatcttataaacatctagctatggtcagtgaaaatatggatgacatgttagaaatctagttattatttagcatattttaatccaaaaattatagcataataaatatgactaataaatatgacatgtatgcaggcgagtgatccaaagctggtgctaacattaacatgctaacagagacaatagcatctagacatatgtttaacaccagagtgaggagaacatacccgcagaacgctctggattcagaggttgtggtgttgatgttgtcgttcccgattgagccgttgccgttccctccattgctattcctgtcgcagttgtcgttgacgtcgttttcgatactgatcgacatgatccggaggttgatgtagaggaagcatatatgacttgatgccgaggaagtagtgctgatgtgaagcagaggaagaagtagagcagtcgcgcgaagaacacgctcccaaaaattttatcgcccacctaaccgtgcatgtactctggtggacggaattcttgaggtctactcgtcccaaata

SEQ ID NO: 109121 - DNA, 725 bp, Oryza sativa
ctctacttttaattttattatgtttattccaaattttagttagtttgaaattcctatatggactctatactctacttctaatattccttatttttttaattccgaatttctatttttttttctaaattgtatttctatatatactctatactttacttctaatattccttatttttaattccgaatttatattatttcctaattgtatttctatatgtactctatattctacttctaatattccttatttttaattccgaatttcagttatttcctaattgtatttctatatgaactctatactctacttctaatatttcttttttttaattctgaatttcagttatttcctaattgtatttctatatggactctagtctcctcttctaatattcctttttttcattccgaatttcagttatttcctaattgtatttctatatagacagactctagtctcctcttctaatattcctttttttaattctgaatttcaactatttctaaattgtatttctatatggactctagtctcctcttctaatattccttattttttaattccgaatttcagctatatttaaattgtatttctatatggactctgtcttttctttttctccgattaatgtgagaatttctaggccatgagagcgaacttggaggttcctttttctattcctttaattatatatttaattccaaatttctttctaaattgtatt

SEQ ID NO: 109122 - DNA, 705 bp, Oryza sativa
tcgcatatcaggttttgcggttcgaggacgtttttatcccgatgataagttgagggaccttcggtgtactttttcctaaatgtggcaggtaagccagtaagcaacgtgacaaaacttgtgggccgataaacgggcttgtaagctgtaaaacgaattaggatgttaggcttgctcgtcgtgtacaagtctataggaagctgaagagtaggccagctgggcctgacaccaactcaagattacaaatgtcaacgtcaatcatgagtttgcagcgaccttaagcccttgtgagatatagtaataaccgaaatgaaatgggtaaagaaagatgaggaagtgatgaaaaagggaacatgtttctcagggaactccaagcagggcgtacaaaccaagaacatggtgtgacctcattttctgatgagaaaatttcttttatggctcctaaattccagaagatctcttatatatttctgagttttgctcgctcactttatggcctcgaatttggttttgatctacttatgcccatttcaccagttgtctattagctgactaggtaatagctatgaaaaggctaatttgtccatagttatgaaatgaatatagaaatctgtaaagtatattattggaagtgtgcaggagtttgttctatgagactactatatttatgactttgttgtgtggggttttattgagaaacatctaggg

SEQ ID NO: 109123 - DNA, 606 bp, Oryza sativa
tgtacgtaaagcaagacaaataggctgtgtttagttacgaaaattggaagtttggttgaaattagaatgatgtgacggaaaagttggaagtttgaaggattattttggaactaacatggccatagttaaggcaattttgaatatgtttgtttacaaactttatgaaaacatgtatgcttgaattcaatgtgattgcaacttcctttcatttcaactagtataattaaattttctctaaatcatttcttctttcttttcctttttatctatctgatacaacggtttaaatgtgatccaggtgtcccacgtggaggtccttgcgcatgtctcatctattctcaaggaatttgggttttgccccaaggaagagtacattgacaccatgaacctgtactgatatcacctctgtattcaatgttagtaatgtttagtatgcaaatggatatttggtttgttgataattaactatttcttcaacttgttcttgaaggtctccttataacctggataatttttacagcgtcgtatttcaggaaggtgtgtgtttattatttaagtaactgtttttgagtttcttagaatgaacccttatttttttaatggacc

SEQ ID NO: 109124 - DNA, 536 bp, Oryza sativa
ctgaccgtcaacagtattgatagtcgtcagcaactaactactaatttgccccatatatatatatttatatatatgcttgcacgagggataaccggaaaagaagagtttggtcaaatatgacggcagagggaataaaaatgatggcactagactgtcaaaactaaggaattattcagctatatcgagaggaaaccgagacatgctcgtatctgcaatccgtttaaaaggtgcaacttttgcgtggcaaagatacaaaatacatgtgtgtgctgaaggagatcgagcctttttatcattccatgcatgcatgcgtgaaaggattagaaaatacaccatctgtgcactcccaaagcatgtcgtgagggcaagtattttgcacgtctcttcacattttgtgcagataaaatttcgtaaataaacttataatcaaagtggattcactcataaagagaaaacgtatgcacgctagtcaagactaatcttgaagaagtatttatgcttgccctccgtcctgtaactgaaaacttactggtact

SEQ ID NO: 109125 - DNA, 572 bp, Oryza sativa
ctcctcgttttcccttttttttgacacattgtattcctttcatgcaaaatttggagttagcttatcttataacatgaaatatgtgcaaattaagcgccggagagataagccatgtggcatgtccttattcatggaattggtctccatgcaaaataacatgcgaaagtgctcgcttgcatctagagagatcgagaaaactgcatattttttgtttaaaaaaaggagagaaacgggagaaatattaggatttctaacccatgattttttttctttaaaagcaattaatacatgttaaatcaaaattcaggcaagtaactccatgatagtaacatcctatatgaatagaaaataaaacataaattaaatagtgaaaccaaaggagttacagccttacagatttatcatttgaacaaatacaatctactacagacttaattgaaaattaagactaatcaagcgtaattacaagtacttatgcaagtaaccccaagaattttcctacaatattaagaaaatattgagataaatacagttaagacaaatactattaccatgttcatatcttatattct

SEQ ID NO: 109126 - DNA, 750 bp, Oryza sativa
ctcgtggctgcccaatccgttgtgcagcaacctctggaaaacgtccaaacttgagcttctcgaagtggccgaacttgttggacagcacttttcgcaccagctcaggcttggtgatggtcaccctgggcactggcccgaaccaggtgatcgacactttacctgccaacaaatatcacataattacgacaagacttcattttcgctctgaatttgtgattacatggatcccttcattcaaatgtatcatcgctttcacaaatatcgtatgataagttgcagttattttagtttataattcatgattatatatgataattgaacatgcttattcaagaaaaataaaaacgatagttttcactaaaagaaaataaaaagatatttctcacaaaaataaaaaagaaatccttgcaaaaagaaaaaaaataaaatttgtagtaacgactaaaaatagggggaaagggagataaggaagcatatcactcctctatattattgacttaataagagacctcgagtgctcatatattagattgtggaggatagaaaattatgcgaaataatggtgcatcccaaatagccaaatgggcatgttggggttcaaatgatagaaatctattattgacaggtatgcgtgaactccaaggtgccacaagattaaatccatatgtaaatccttggccttaataaatcaactgcagataatctggcaccatcatgacagaaatctggttcatctctacgtgtatacct

SEQ ID NO: 109127 - DNA, 872 bp, Oryza sativa
catttttttctcctctttcaattttgatgactgcaaggaatgtaaacgagagcttgtcgggggcgtgtgatctcagcatcgacatcagcatggtagagacccctcgcgggcaataaccggtcggcggacggtttgaccatggtcgagaaaactgaggagaaccgtatgaaaccgtcacggcacacgacacggtcgcgcggaccattgaacggtaggagacgagacccgtagcaagtgggtgtgcaaccgtgctgtgcctatccaacgcgaccccatgccgattcgtctctccaagttcctctctccgaaagcgaccgcgatctgttgaggaggaggaggatcacgggattttcaccggcctcacgggagatttgccgtgttgaacgtacggcagctgtggaatatcaatcggtcgaagagaagatacgcggtagtacgaaacgtgcctacaatgggcgggcagctaaaaaagggaaggcacacatatacgccctgcttggccggagccaagaaaaaggaaagaaaaaacgctggtgctcgtgtagtcgctgaaaaaagagaagaactacacgtgcgtgccgtggctggacgcgccggccagccgtccggctagatatcgtatgagtgtacctaatcgccatccctcgcggggcgcgcgcattgctccggcctcctatcgtgcgcctttgtcttttgctcgcgcgtggctttagttttgccgtgcatgagtgcgcgcgtgacagcgccaccacctgccgcctgctggatctcggcttaaaattgggactttagctagctttgttctcctgttggtgaggggcagcgatcacgtaaaacgggacagagggccatgtgaccacaaagtataaatg

SEQ ID NO: 109128 - DNA, 720 bp, Oryza sativa
gagaaaggggagaagtgggagtagcctataggggagcggggggtgggatccgatcgcagggcgatcagccctggcgatcgatcgatcgcgcattagccccccatgcggcatgggcttatatgactcgggaaaatatgtggaaccccccgtcacccggtgataccgctcagggcgtccgcagtatgactctaccgctctacgcggctgacgaaacagctcactccgcttcccgagtcacgagcacgccggatgggcggcgccgcggcctttctttgctccgccgcacgtgcgcgccgcgccggcgccgctgctccccctctctctccgcgcagagccgcaaacctggcgcgcgatggccgcacgcgctccggcccccggcttcccgttccacgcgtcgggtagccagtggacgcagccgcaaaggaggagcaaaagatcaagcgccgtccacgtgtaccccaccaactccatgaattcccagggcctccaggtcgtcaccgatccgacgtcgcttacagccgggcccggaatctaccggcccaaccttgccagtgactaaccagaacgacgagtacgattagtagcccgattagataaagtggggactaatcgccaatattaaacttaacaggtggactccgctggtggcatgatgagctacccatcctcgccgtccacgtgtacacctcggcccctgatgccccgcaccaaccgtcctcc

SEQ ID NO: 109129 - DNA, 545 bp, Oryza sativa
tgtacatggtaatggttaaagttgcccttcgcggctatagttgcctcttgcgcgaggacttaaaaataagaaccactatacagaggtgccatattgctaattaacataataactaggtttgtccccattctagaaactgcggtcgtacctgttcgtcgacataagtacctggtaaaacttatatcgatcgagacagtactagccacccggaaatcatccaaatcttacgtactgtgccaatctaagtataaggtattttaaccagattgtaagcaaagtaggcaatactaaaattatctgggtttctatgattgatttatgcatataaaatagaatattgaatagaaggctataaataaataatttgtaaaatataggtctaaatgatcaaaagttatatggtaacttgccttgctcgatgtcctgagattcattgatattatctattgagtcagaagaatcctcaagacctcgggctagacatataaaaattcaaatttaaaagaagttcaaataaaatccaaaaataagaaaaatggagaaaa

SEQ ID NO: 109130 - DNA, 557 bp, Oryza sativa
tggttttcttcattcacaaaacacaaaagccatacctacccgaggaaggttggatacatatatatatatagccatagctggctgctagcctattgctgcaccctcctagtctaaaattcgaaatttaaatgggatgctgtcctagagggcatccaaacttaataaagcataaaggaggcataaaggagatgctaactgctgctgtcctactaaccgcaactgtcctagcaactgaaaaatatgctaaagggtagatgctgtcctgaaaaaggtgaaactacccaaaagcaaaaagaagaatcacgaccaaggaccacaaagacttatccaacaacctcaatggaatacctgattgaatcattgacaagtagccttgccctgacaagtttggatcttgctaggtcactgtcctccttgtcactaataaagtttagcatggttagccttgccaagtgtaccaaagtaacagctacctgtaacattaggaacaacaggaaatcaatcactgtccactggagatggaatcatttcaaaaactgtgttaagtagtcgcaata

SEQ ID NO: 109131 - DNA, 630 bp, Oryza sativa
ggcctccgccgtcgcctccgagcccctttaaaaggatccccgtgctcttctcttctcgccgtgtcgcgtcccaaatcgactctaaaatctatcctcgaaattgtgcaaagaataattaaaattccatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaataaacaaagttgaaaaggtttaaaaaaaaaagaaaatcctaaaagaagttctttttccccccccccttccctcttgggccggctcggcccacttctccctccctctctctctctcctcccccgcggcccatcggcctccccgcgcgcgcgcgcgccgctgacaggcgggcccgcccgccactctcgctgacgggtgggacccacctgtcatcgccttcctcccgccgcgcccgtgccctagcgccgccgccgccgcggattgtgccgcatcccgccgtccccgcgcgcattaaagagaggggaatcactccccgtgattccctctcccgtttcccccgttttcccctctctctctccctcgg

SEQ ID NO: 109132 - DNA, 541 bp, Oryza sativa
tgcctttggcttgcttagcacgtgaccccacgtggtacgaaaggctaggaggaaaagcatttctcgggattcaatggattctctccattgggctctctactttgcacactaggctgcaagcttgacttggtgtgaggaggctggtttagcgatgtctgccctgctaaaccaaaggaaggggcttctttggcatatacccatggacaattcagggcatagtgtccttgttctctacaatcatgacaaaaggggacatgctcctctggcattggaagctcattgacctgggtggcaaatgcttgatcaaacacatactgattttggtcttgacttccaaccaatggtagctgtgaactaagcagtatgcttggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagccaggaaagaatagaccag

SEQ ID NO: 109133 - DNA, 2624 bp, Oryza sativa
cttcggccgcgggccgaggggagagagggaggactttgggccagacttggcccaaaggaggaaggagggttatttttaggtttttctttttaataaactttgttaattgtttttgttgcttaataattatttccggtgctataaaaattcaagtaaaatttgagggctccttttagaccaaggagaatttaacaaaaattctccgggccacatttgaatttttcttgcacgtattttagtgtttgccaatttctttccgaattttaattaattctattattccttttagaaaatgatttttaattcgggatgaatttatcaggacgtgacaaatccaccccccttacaagaatctcgtccccgagattcgaggaggctagcaagaagataggttgggcggtcttctcttcttgtctgacttcttccgtcgcgtcttctataacaaacttgcctagcaaaactcctccactctggactgcttggctcgatctcctgttgcagatggaatcttctcttcacctgacttgtccctggttgaacctttagctgacttcgactgggttgtggcacttgatgatggggcttcagatccagaacttctcatagttcatatctttggcgtcaacctcatacaacttacccacttcatgtcatgcgtcaacactagcttgtcattactaggataccatgtttgtcatcataagaatatcatgcttatcatttacttctaacttgccactgaatgctttggactatgatgtcacgcttatccagcataccatgtttgacaacttgtcactaactgcatcatattagctttcctggcctccgggtgctagatactactgctattcgatgcaagggtcgataacttttgcctttgaattacgtttctcaaaagaaccaacttatcccacttgacatgctttgacatctttctaaatgactttactgctgaacttgttattgtctgatcgttttcctgccaaatctgaagcttcgttgttagatgtgattttaatctgacctctgtaaactatcttcgaacatatcacttggttcataactgggaatagctcccatgaacaagcaactcggattcacttgctttacattcagtttacttcccactattcacttcatgttgtcctcagttagcattcaacgtattcctttacacctttgaccttgatgtgttctttcccgattcctcttatcaatcacctttcgacctacttctttgcctggtaataaacatctttttcgatatctcctatcagtcatcttttgacctttgtcaactaagtactcttcactccgagagttgtggatgcttctggtgacgatgtggtacttgagcctgctgcctttcagagaaaccttcaagtggttcgtcaaaagctagactggcggttgttgcctttgatccaaagaggacacatctgaaactctcagtccaaacaaaagtctctttggctttttaatccgacacagtttaattggttttcttttccatcaacaggttggttattaactcgaggttagaacatagttcctctggaatgagaccctaggtctcctttgacagtaaacaattatacgcatgatcccatatcagcatcttccaaaataatcctcatagaacttgtttttatcacacatgtctcccttattacatgaatacaaggcactgccttaaacaaaaagggaaggtgcttaacatcggtacattgtatcctcgacaggaatcatccataaacgtagcaagctcattatttataatcatgaatatatttatttattacatgattgctgcaaactcccgattacagtgataagtagcgaactgaaaatcacaaacatggctacatagctggcattgttctagtgactgcatccttgattggttctgtgatgatatgataggactgcatattgctatcattcacaggagaagcttccttctgattgctggttgaagcgaataacggtcttctgcttggtatcgccctcctgaggttgattgccctttgctcggcctggagtaggtcggggagagacacaacttcttccatcgacgacaattctttgctaaggccgtcggtgcagagaatggttggtgctgaaggtattattgctatgatttattgcagagtcaggtgcagcaggaggagcattggtgctgtggatgatatcgtcgatgttgttgttggagctgactagctgatgagacaatcgtagggttgttcgttggatttctgcggtcttggtcaacaacacactgagttggcaatccttgggcacatggtttgtaccttcgcatagaaaacatgtgaccttgcgggtgggacattcacctggtggatggtcttcctcacaatgagggcagagtgtgagacacatgctagcaacatgtccaatttctccacaacgggggcatgcttttgattccatctcttcctcgccgagatgtcggggagactcatcttcatcatccgaggagacttgatctgacccttcactatcagatactctgccaccatggcttagaaggtgctgggtcaactgtcgtgcacctcggaaggtatttcctctttgccgtctaggaatagttatccctgctg

SEQ ID NO: 109134 - DNA, 1494 bp, Oryza sativa
tcgtctttacaaaatggctttgggcaactaagtgacttttaaatgctgtttactgcaaaacttaatccctatattattattcccttgtacctcccttgcattaattatgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggcctggagcgcctttgtaataatgtaaatactatcgatgtaataaagatgtgtcttttatatcatgtttgtgtggtgtaccccggcttttcctgggacggggattaatacactagcgttcgggaaaaggcaattttcccggtcgcgacaaaaaccaaatttttgccactttgattttgcaaaagcaatctctctctccttctgtttatgagctaatctgaaacaaaaaccaacaatgtgtccatctttgccacaaaaagaacaagtatatttttcacgatgattagacacattggtagcattagaagatttagcagcacaagcaacaacaagagattttgcatgcacaacattggattttgaagaagatgcactcatagtagacatgataccagcagatttaaacacagttttgttagtatcaggtttaaccaaaatctcaccccttctagtaccaacacctaacacaacaggaggatgtctaaaattatgagtataaggattaaaacctaaatcacggttatgtgtgctaacctttgattgatccaaaatcatgttgaggttttttttaccatcagaaaatcttagcaaagaattttttaaataagaaacctctttttccaaattagcacaattttcacaatctaccatgacacctttgcttttacgacatttagggcaagaaagcacttcattgtttttcacaacatcttctatgtactcaacacgacctaaagcatctttcaatttcaacttattcaaagcacatgttgagcaatccaaaacatcatgaggttgttttaactttttagcagaaatcatgttaaacatcaaactagcatgaaaagcaatttgatatttttgcaacaactttttagttaaaaacaactcatccaaagtgcctgtgtgcaaggcaaaactacaagcaagagaagatctatttttcaaattatgtgcagcattaacatctctaatttttgaaatctcattcattaaaacctcacaatttgagcaatcatcatcattaggaataagagattttaatctagcaatttcagatttaagagattcaataataaattccttttttctatacatcttctcacacttctaatttttttcactcaaaatattaatagcttcctcaaaagcacttacctcattatcttcatactctgtgtcagattcaccacgcgccatg

SEQ ID NO: 109135 - DNA, 920 bp, Oryza sativa
tggagggctggaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatataacaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatacacacttacgtggcgaaaagcaatgatattgtatctaatcaattgcttaaaaacccaaacagcaccttgacttatatataaaaaagtcagcgagacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtgacatgctcccgagtaataaatcttccgggtaatatagaccaagcgtagctcatatgaatagcttctgatctg

SEQ ID NO: 109136 - DNA, 607 bp, Oryza sativa
ggttagggattcaggttctggattttttttttttttgctttgattcccttcaggctaagaaaggaagaagtttgtacttatccagtgtttcagtatgttgtatctagaactacaaatacaaatacaaatacaggatatggttgatgatctgcaattcttcttctctatatactgtctgtgttgatcttttagattgcccaatttgggattatcagaaaatgtttctagattatcagaaaatgtcatcaatccttatatgtttctaaattatcagaaaatttcctttaaaaaatattatgagaaaatggaagtgttgtaaacatctctgcttgttttccattgccaaacagactccattttggattttattaaccaatatagtatgtattctcctggttattacaacaaatcacttgttgcactcaagtgcgagatttagccatcaaagctagatggtgtaaaaagattttgttgtttccaccatcttctgcttttggtagatggagtaaaaagattttgttttaaacctttctgatggttaataaagctgtttttttggtgatccattaagctagcagcacttaccgttcccatggactgaagatgc

SEQ ID NO: 109137 - DNA, 741 bp, Oryza sativa
agtggatcccccatgtttttctttttctctcgtttttaggcgcagaagcccgaaattcatttctcctgttgggctaaaagtcacacttatatggtcctgggaatctgggatgggcgtgggtcagcccgctggtaatgattaattggtccattcagattcaagtaatcaagattcgaaaaaggctatttatactccctccttaaagatcagatccgattgttattcctcaactataaaactgggtatatttactcctccaactattaaactatgcaaaactatactctctcagtggttttagaatggttttggccacatggagtccaatggatagcccaataattagagaaattaaaaactaaagtgaggctcacctgtcggtgattctcccatcttctcttatctatcctctctaatccccattcttctcgccctcctgaaggtcgacgctagtattgtcaagacagaataggtatcagtcggcttcgatatcaaaagtagtcttggccgtgtttggctttaattgggccaaaaacactagacgcaaaacttacaacccaattacacccaacacttcacataaagaaataagttcactttaggtccatcatcttaacgacgagtttaaattgcgtccttgaaaccataatacaaagtataacgcatctctcaccttgcaatataggtgtacacgagatccttaggcaatagagttattggttttagctgacatgacgagtt

SEQ ID NO: 109138 - DNA, 665 bp, Oryza sativa
ctccgccccatctctcttctcttgcgtttagtatgcttttcatttacaggggatctaatcctgactctcgatgcacaagcctacagtggtaaaggcaaataccattgtatttttttctctatcttttttgtctttcttttttctttattcttggtttttgccgttgtttgcagtagtagttcttacagggggaattaagagcatttttcccctcagattggagagatcgtagatgttttcttttcttccaacaagtgaatttttttaaatttttttggcgttgtttattatgcataagatgtctcttacatacatgtgcatagaaacggcataattgataaatggatataattaatgagggcacttttgtcttttcacgtttatacaaaatttgcattgaggatctatgaatccactctttttaaggacggaggaagtagatctgttctatcacataattttttcctccctgcttgagttcctctcacacttcctccaccactatcgcgacaaatcaagtggtgtgcatactccctattcctcctcacctcttccataagagccctgttcccccctcccctctcttctcaccttggcgagatagacggagcgcacagtgatgaagtcgtcatcacagatgaagcgaagggcgaggtggccctgtc

SEQ ID NO: 109139 - DNA, 1715 bp, Oryza sativa
agttttgtggttggtcggcttctagattgtgtcaaagaaactgatcaccaagctaagatcattgtggatcatatggattattttactagtagaatttctttgccactaattgcagagggaccagatgatctgggttgaagctactggtgtacgaaatcaaatcaaatcagatagtttgcccttcttgttgacggagacatcttggacatgatgacttggatgttggtttcagatgttggtagaagtagtcgttgaagcttgaaagcagctaagctatactacctccgtaaaaaataaaaaatccaaactgtatgggatgaaatatttttctagtacaacgaacaatcttatgctagaaaatatcccatccaatattagttgttgtttttttttgacggagggaatagactatagggtgatctactactactgctctcctatctctgtcagacgctcttcatgcgctctgaggcgcatactagatcgatcactagatgaatttgttttcacaaaatagatgaaacaaaattgtactccggaccatcttggtttgaagccaagtcataccaaattgttgacccttttaatagtactttgttagtatttgttttgctatcaaaatgtgccaagaacacacattttgataaaaaaaatggtgttggagcaaatccaactagtgtattctagccttttctgttgcgttcctcctcttcaatttggggattatgtacacatttatagtctgtacaagacatgggaaattacattcataaccctacagacctaaacccttcccagtgagcagataggcccacctagggggtaactgagtcatttcctgggagacaaatgcagggatggcgcccattaaggcggcatcttggctcactttggggttcccctgatggcccggctacaggctattacttaggtaatatccctcccccagtccatggcgagctctggtctctgcctcaccagccgcaccagggtgtccgagggtggttggcggctactatgcgctttaatgaacgcccatccttgctgatgcctcgggctccgtcaaggaagggagatgctccgaagctggtctccctcagagctgttgcgaagccctaatggagcctcacctccggctcggtgacaggggattcccctctggagccagtcagccaggccacaatccttagacttggctccggtggagagcccgaatcctccttttgggtcccctgaggatacctccgaagcggaggcccccctcgacgcattaggaggctctccggaagttgctgaggtcgaagctacttccccaacaatggcactaccaaaacataccacattgccatctttttggcatagtaccaaatcaaacaaaccctccctccgtaacacatgtcaggtattagctttttacacggtttccaacatatactatgactattaatttcaattctactatcatgatacttctatatatattatgcatcatatgaaaatgtatttttaaatacgaatctaatgatacatgcatgtacaacactattagtcaaaatttttaaacatagacattgttgaaaacatgactttttatattttaggatagaacgagttgaacggatcgcaacgaaggctgaggttgaagataaactttgaaggcaaccggattctgaaattctttgtgtacagatgtaactgatgcttttgaagtagtg

SEQ ID NO: 109140 - DNA, 838 bp, Oryza sativa
ggaacatgacaagctattttgacttcatcaaatctttcatgttttaatttgcatgtgaaactgtgattccatttgataaaattaggacaagacttgaattatcacagcaaatataacacttaccttaaatctcaatgacctttcattagtaaattggttatgtttttttaattaaacctagcgtaactaatcttttggtagcaatggggcactaaaaataaaagggaacaacttattgctagacatacaagagaggaaatccaaaattatgagcatgctaatatgcatagtttatacaggcaataactcttatgtcacatccaagcttttggcgatctaatatactactaacccaacaatctaaaacatgctatcaacacaacacaaatctaagtgacgcatccccaatcatgacaccaacatgagatgcatatacatttgcttggattattgtcacggattgtttatttgattaatataatgattaatattttgaagactaaacttaaaaatagtttagaataggttgtctaatcactgtagtggagagaaagtttttttttttaagaaatcatattttttaagaagtgaggagcaaataatccgtggtaaaaatcttgagaaaaattataaaaggagcagggccattttctcgtagcaggtggccaggtgctagaggcaacacaattacacaagcgcaaaacccatatgtaagagttaaaaatcacaagcttatcttcacgccttttcaatccaagtcctggaaggacctgttaatgatttcgataaaaccagtggtgggcctagcaaagaagagacgatcccttgcaaatgcgaa

SEQ ID NO: 109141 - DNA, 1355 bp, Oryza sativa
gcccatgcgatagcaaaatgtaaatggaaggtgataggaaataagggaacctatcccgcctgatgtactcagatagcatgtaccaggattataagggataccacatcacacttaccgccggacgcaccctcactatataagaggtggcggtatgaaccctagggggtgacatacactctcactcatattcactggacatagatacaatccacatacaactggattagggtattaccttgtattgagggcctaaatcagtataaacatctgtgtcaccatctctccttgatcttgcgcaccctataaattttattgctgatattagaaatcgacatttatgggagagaggagatttgtttggctgtttcgcctatgagagcagttatccactaaatttgtatgcttgacgatggaggagagccaaatctactctcctagccagggcaagcaaattcttgccaaaactacctttttcttggcaaagctagccttttgaaccacataccaaacatcaggcctagccaagcaagggtaggaacgttctagcctaggatccaaatgctttcctaaatattatgaagttgaaaggaaaaatatagagttaccttttatatcttgaaaaggttgaaaaatagtaagtagcagggcctgtgcaatgttcactcagtcggaccctccccaccctacctacccaaattaaaatctaaattatcaaggggtgagattgctacaagatttgtgtaacaaaatgaaaacaaatattctctccaccctgttgccatcgctcctactcaaccacatcttgagtaatgttgccatttgtcctttcccttgcttgcaccattgtaacccattttcttgaacaccggtgtgctttcctcgctctacaactcctaactcttctttagctcctcacctctgatgagttgcccctaattaacccagatgacccaattcaacttacttgtcagagtttaagtcatttctatcgcaccactgagaaaactgctagcatttctatatgttgtcccctctccctcttcatcaactggagattgaaaacaatatttgagattcaaagaaactcaatcacatgatgagtaaaaaaaatgtcaccaacatcacaactagcatttagattcataatacaatcgatagaatcacaaattatagattgatacatggtgcatacatgtatgatggaaaatttaagtagggaaatttctagctccctagaaatatagaaaaccatctaaccatgacatatataccatgtcaactgtccccatcgcccaaccaaaacaactagataacaatctaaacatgaacaagtattgcgctggttaggggagtgt

SEQ ID NO: 109142 - DNA, 1078 bp, Oryza sativa
aaaaggatggtacatgcgcttgttagtttgtgcatgcttgagatttttgacacattttcttcttttttgggaggttgtgtgcattaattgctcttatatctactttaagaaaccttagaagatattaaaggatatctttattaaattggtgggagaataaaatgcatttatattcctaaatatttgtatggggatataaatctatctgcttttatggaagtatatatattattggactgccaaatttattcattttatcttttcgagaaaagtgagttattacgattgaattagtttgaaatattttatttaacatttattgcaagatatagatcttctgcaataaatgcaaaaggttgttgtgtgaacattaatgtgttttgaactatagtacggttcaataatttgacatgagaattttttaagggggtagggacaaaatttcaaaaacaaattaatttaagagttcatttaagagttctatcgaatgttatgaatgattgttttttatgaatttcaaaattcgaacaaaactctactgcatttttgttcatccctagatgactttgtcagacaacaaggtggtaggacgaggtgaacgaggatgtatgtaacattatccagtgctagcgatgttgggcatagaggttattcactcagtgttccttgattgcgaattcctcacatctagaggggcaaggaagaacggcttctatggagctaccactgatgcaattgacctatgtctacacatgaagaggattgagccatcatgaagaaagtgctttcgtataaaggacattttttaaactaatgatctgttcagattactatcaaaattaacattttcaaaagttgctaattccaaaatttcggtaaattggtagcattgtcaagattttatagaatagtttaaatgtattgttgccaaaattttctatgcattatcaatgtttgataacaaactaaatgcaaccatatatttatcaactttatcaaataatgtaatgatttaaaatgatattaatctgaacatgccctaaggtggctaggctctagaaccgatcaatggatctaa

SEQ ID NO: 109143 - DNA, 590 bp, Oryza sativa
catttggaggcaacataacactcgaagtcgccatcgggctatacacctttcaacctgacgggtcggcatcacaacagtcaagtggtcgcgtccggattgataagatatttctttcttgggagcggggcggcgtaccaacgcgtcagcgccaagccgtgaaacccttcatgctgatgaggcaggcaccgtgatatatcaacggtttcaatcggtctgataaaatgtcttcaattgtggcatgggtctttttcgctgcgagtaggagacgatttcaagttattttgttggctggcacctatacttggtcccgacaaaattcctttaattattatttgaaggcatggatcttcgcctcgagacctcaggaggacagcttatacctgaagtcatttttattcttcacctattctcaaagcgccagactttctgaacggtgctactaccccacatgggttgatctattatatgaagcaacttgtacagaaggcaaaccaggaattgatggaagagatcatgcatgcagctgcatgagtacagaatttgtgtatggcactgtagcatggtgatgatgcgtcgtcctctgattgctc

SEQ ID NO: 109144 - DNA, 569 bp, Oryza sativa
gcttttgagtcgagggtcccggagttgaagcggcatcagccgtcggcatcacccgagaagagcggacaggagcattagcagccagcacaactgaaggtacatcgtcaataggtaccggagcaacatcggaagaggcagtagctttaagtccacccaaagcagttgcctgctctatcgtatcctgagttgcaagtatgttctaagagacaggttatcaaaccagtatgacatagaattttaagagaaaaaaaaagaataggggaaacacggataccttgccagtgccatcagaagaagaagaagaggaggaggagtcgctcaactggacagcatcaagctccatgtcgggcaccacagagcggcggcggcggcgacgatcatcgcttgaagactccgtggatgacaccctctcgtaaactacggggttttttcctcgcttctcacgcatggtgcggtccagctcggggtgtggagaatcttcaatacgcagaccctttttagaagatttcggcaatggaagtctgtcaggacgagcagttctctccttcttatgacgccagtcacgcagg

SEQ ID NO: 109145 - DNA, 692 bp, Oryza sativa
tctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtacataggtaggatgagactagagtgatcagtgagggagaccactgacattctgcttgtgcttaatcctcttaactctgaagatcatccttcctgggcccccactcctcttcagaaaagcctgaagctagcttagttaagtgctaactatagcactgatccatgattaaaatactaattacctccacctgttaccagcatccacccaaggactaaggacaaaccacgagccaagctccgactattaagtcattaactaaccaaaagctcctcaatccatgccccctcctagatggcactttatccccttcattaacacctctcccatcccttctaccaacctaccaacctaacccccccaaaaaagagagagcatctcacatgctctccattctctcccccctggccccctgatctccctcctctctatctacaagacaaaccttttctttattttttttcttttaaaactgtgcctccttttctcactggctgctcatgtgattgcaaacatttatcaagaaacctaactt

SEQ ID NO: 109146 - DNA, 810 bp, Oryza sativa
gacaggtgcttcccaaaaccatttgtgtgatcagcacaactaatcaaaatatgtctatttatgttcttcacatcagttcttaacatttttttatatgtgcaggtatgccacttgagactttccaaaatgcggtgaacattgaaaaagaaatcgtgcaaagcgcaaagaagaaagcactttgggtcaagaagattgaaaaagtacgtaaaaactgtgtgatatgatgattaatgtttatcacatttttcaataacgaatttatgttaaatacacaaatgctgtttctgttgcagattgtggaggaacttgtgtacattgtgcattacttgccttctgagatcaattgtgtcttctacaaggaacatgaagaggatagatctgtgaaggctaatgggagccctcagcaaactttagggtctgctgatctccagctgaattacgcaaggatcgttatcgccatacaagttttggtaagattctttgacagtcattaggccattgttctaggatcttggtcattgatcaagtgtagtcgtgcatgatataaacatatttccggttttcagttgatttggcacactaactgaaatgtcgaaactgattttatttgttcataaagtttcaatcgcaggtatccgtcgcatcatcggttccgcaatgtgctgtagattcattgttccatgcactgccttatagaatcagatcagttttgctacctaggatgagacacggcgattttgacgaccaggtgaccactcttttctgtcaattccgattacctgacaaaaatgtgtatcctgtatatactgt

SEQ ID NO: 109147 - DNA, 1451 bp, Oryza sativa
ggtctctctctattaccatgcaagtaaatttggtgacatgtaggaaagagaaaggagtatggttgttatgcatgacaacgactcagagtcgactcttagcatttactaaagcaaattttgttgcatggtggtgaaagaaagaaaataaaagtaagaaaaagtattttgatacattaatgattagagaccatattgtctctaactgttgtaggatgctagtctctaaataacgtagagctcatatccgactctaaataacgtagagctcatatccgactctacctttgtacatgccctaaagataaagatggagttatctttaaaaaaaacgagaaatccattagcacataatcagtagtgttttaattattataaacttggaaacatatttatctgatattttatagcaacatttatatggaaagttttcacgcgaaatacatggtttaatagtttaaaaacgtgctaatgaaatcgaggtaaaatctatattttactcgaaaaagaacgggacctgagtacacttttagagaaatattaagctcatatgcggcgcagtaaattactactggcatgtttggtaagttctaacttttaaatttagctctgaagttgtggagttgtctaaacccagctctacctctttagtttattttgtgtgagaactctatccagctcgttttctttttaggtagagttgaaactaaagctgaaactgttttgctgatctagaccgtgccaaacataacctgcattgcgtgcgaggcgagagatttgagatattatgcgctcgtgttgtggtatgttgatagatgtagtgatgagagttgtgacagttgagagcgagacgaagaaacgcgtgagggaattaatgcatgtgccagaatctacacgttcacacttcaacaacactatcgagcttgtcgccgaaccttgcacgttaagatcgacacggaattgacaggtacggaataatgataatagtgtcctactactgctattttcctgctgattctgtgcagcaaccaccagcaactattgctatataccacatgaggcgagaaaaaaaaagatactatgccataccttgcaagcaaaagcaagcacttgcagcagcaaggagctgcgaccatggctccatccaagcagaagccatactgctcactaggctatcagaagaacatttatccaacgaggtgttggaagtatacagcaaaagaacttatatttacagagagaaaactagtgtgatacagggtgtataaatatgtacgggatgtatgcacatacatacattcatattaacagtccatgcccctacaaaactcgcttcgtcatgtcctgatcttccaagctccccataaatatcccaatggtataggatgtaattatgggcggaaaaacagtgttcacctgaatatcttgttgcctgatactgtgatctgcaagct

SEQ ID NO: 109148 - DNA, 855 bp, Oryza sativa
acctccgagattatgatgaaacattaatggtggaggatgctttgccgcaccttacctctctccaaacaggggcggcaaagctcatggtctaggcgatggcaaggacaactggacgaggggtgcggcgtgatggagatagcaacactttgtttgggaaggtgaggatatagtggcatggacaacttgatgataagtgtctataaggtgagagttgggtaggaggtcacggtgagggtcgaggaaggacgggcaatacatttaatagtcacgtgccgaatgcttggtagggtaacaattaaggtgaaaaaaatgtgacattaaatgtttgagacacataaatgaaaaacttgttacaattaatgatcaaatatacttcaaagattacaatgaaacattaatcacgggggatgtttcgttgcatctaaatgcaccaaatattaatagcgaaggatgctttgccacatataaatgcacaaaatgtatgttatgttcccacttattaaacacagttgaattcttttatgaaaaaatagtgaagtcgatacaactagcatcaactatccgacacaattttagtttgaattccaaatctgatccacacattaagaaaaaaataaatccagtttatgagtagtaatgtggttgtaggaaatgatatgttgtggattgccaagggtggaataggggaggggggttgttgtcaaaaaggaaatcaattgcattaaaaaacaacgatttttatggtgatgagataatgattattaaagacttatatttatagataaaatgtaacaaaagttctaagcatgctatattccatattctcatatcattttaaggtgatggaagtaagtt

SEQ ID NO: 109149 - DNA, 1105 bp, Oryza sativa
tggccatacaaatgtatgtacagcttcaccgtagatggggacaagttgggagcatattggacgtactgacaaccattccaactggtaaatggacaaagagataatgtagctagctgaggtagttttcatgttggcctcaggacaaaataaaaggccagcaactatagctaggctaacccactaattaacactgatgtctcacctaatagtgcacaatccaatctactaccaaatttaatcttggagatgctttttggtccttttgtttcatcatttttgttttggagcaacttttccaactccaagctggtccttttggttccttgggttctagaagccctgtggtgtgtacctacctacctacctaccaacttccccttatttggtacctaaactaaccagcatggatactgttggctaatagtctactgatcaatcaattgatgtataccattacaaagattgtgtaatagattatggaaagagatggtgggcatcagccatttggctacctatggtaagagtgtactagatcccttaattagttttcatgatctaaccaataggcacataggaattctttttttcttcttaagttaactgctaacaccactctctcttcactactggaattccacggggtccctagggttttcaaatgttccctagagccctaattagaacccaaggggataataagttccctagagccggaactaaaactcaagggaactgagatgatccctagagtttttgcttgctcatagggaaactagtacagttggcactgataggagaaccacggtggcagggtccactgactttttcagaaaccaaccatgtggaaaggttgtaatagtttctcccgccttgtgaatccaaaatttggactgacaccatattcgctttccattggaaagtaataaagtaccccaagctgtaaactttcccctttcttcttccttcaacatgttctttcatctcttcctccccaaatcaactccctctccagtctccaccaccaaatctactctcaagtagtagagatcgacaggagcttcaaccttcgagggtggttgcagcagcactcctgaaggggggcagg

SEQ ID NO: 109150 - DNA, 945 bp, Oryza sativa
ttttctgtccaggtggcattcaatccctacattttggaacacgtggaaagcttctttccctagattctactaagaaaacccaagggaatcaatttgttcccgtagaatgcttccctatgggccattccctagggttcactgtagggaaacccgatccctagagtttttggctgttccctagggtttttagctctagggattactggaagtgacacagaagattattagacgaaaatggctagaagtactagtaggtttattgtgatattacagaaaactatcgtgacttaacgtcagtggcgtatgtatgggtggtctaacttatataattttttaaataccctaaatataactaagttaaaagtataaattgatcaaatatacatagtaatataataataaaagagttttttttaagatttatgttctcatatgcatatatataaatatatatgtattgggataggattttttgggtggtactgggaccacccctagaagcgcctatgcttgacgtggctatagtagtgtattaatactaatatcttagggattaaggtagatcaagttaaaagaacaagctagaacatctgagtacaggtcgtccatgtgccatgttattctctgaacacgacagaaacaaaatattctaaccaacttcaatttaatttctgacatcaaaacagcacacatgcacattgatttgttcaacatggaaataaggatcattaaacaaataacgccggcggtgtctgttccttgcaggccattacgttgctttacgtagtattactggtaaaccagggaagaactttctccatgatacgccatcagaaaatgttattttcatcgctcgtaattgtcaccccagaatctctctgttcagaccacgagcctcattttattttatgcttatacttattaaacaatttaattttttaactt

SEQ ID NO: 109151 - DNA, 567 bp, Oryza sativa
ccttatgctgccgatcacggtcttcagtgtccgagatttagccactggttcgttggaatcctctgatggattgcctgatattcctttgctggttctcctgacagaagtgtccatttctgatacctaaatgatcaaagaaagatttagtctaattgatgcacgatgtattgttcttgattagccacatcacaaatattgaaatagataggttccttttaaaaggaaatggtgcattttcatgaatgatccgcaaaaacataaccaaactgtgaatatgtcttccccacaaataaaaaaaaaatctattaatatgttttccacacacacacacacacacaaagctgaatatgtcttccccacaaattaaaaaactgtgaatgcgtcttccccgcaaaaaaaaaatgtgaatatgtttaaaacgtagatcctaaatcccacatttatgatgtttctttttatctcaacccacatatgcatgatgatgccctagcatattcttctccctggaacaccaccatttctgaaactttcatcccaaagaaatcaaatcaatgcataaaaccactg

SEQ ID NO: 109152 - DNA, 1143 bp, Oryza sativa
aaatggtgctgtatccatgggaaacaatgtatcccgaggtcaaggtgcttcatggcttcatgtcccatgattttatcatgctcatattttaagtattgtagtataccgttactctaataaaaaataatattagttggttacatgcaacatatttaatgatgtgaatttactcttcgtttacataaataaacgaagatacatttattaaatgatgcccattttggaaaaacctcaataaccttaggccatgtttgacaaatgggatagagaaatgatttcccacccactaaaagacatctttaaatcctaaccattcattctccccctttcatttaatcctaacccttcattcatttcccaatcccaatcccacctctcatttcccattatccaaacacacccttagagaatgattaaaatgggatggaggaagtattttgatgttattgatcttgttaacctttactagaggatgatcaaattgggatctagggattgataataagcattcattcctagataaaaaaaactaacacttgtaatgcatgcaacgagcacggatgcaggtcctctgcagtactgcatgtgcagtactactcactgacatgtgggcccgatgtgcagtactactcactgacatgtgggcccgagggcctgtggggcccacatgttagtgagcagtactgcacatgcagtactgcagaggatctcaattggacgagcacatatgcctctacaatctatatgtgtggtgggaccattctacattcgattggaccattcaacatatctacatagcagccatttactactccaactttatacactcttagggtatccacaatatagcattttagcaggtaataagcattaaatactcacttattacccggtagtaaccattgtaggactagtaagtagttgcagcccggtaacacggctacaatcgggtaacaggaattaaactatcttatttgcacggtgtttctgataaaatgcatggaaataagtcacggctagagattgccatcggtgattttttctgaagctggccctaccttgtttcctactgatatgctgatacattgtggagtgcatgattgcttactactacttgtagacctggcccatactactgacaca

SEQ ID NO: 109153 - DNA, 1051 bp, Oryza sativa
atatggtagtttagacatggtgtctacattacgggatatcattatttggggttatatatgccggtgagaggtgggccgctgatgatgacagctcagtatgggtattcctccgtatttagcaccggttatatggtcatgacgggctgtcgtaaggaactcggcagttaggggtggcttctcgaagtaccagtagggcatcggatagagggtattagctagtatatcaggttaactagtgtatgtatactatgtatattagaagtataggaatatattttctttctcttttctttccacttagcttagatgatatattatgagaatgagtagttaatgcttgtgtgtcactctaccattggattatcttaacccctgtttagaatatgattatcacaagtaatatataaattattagtcaatgttctctctacatgatcttcccacaggataaaataaatacgatacccttggaatactctcgggtgaaatgttacaatggtatatccgtgcgcttgtggatgaactctgtagccataatataccagaagtatttatgcgccattgctgggaattatatatattctattgcccattatctaaaaatatattatattgcctatttaataaaacatggttttagtaaaactatagattcaaagggtctattaaacctcaggtcttctgttcttcccaaacaaaaactacatttttcaatattccatggtataaaacgtacatgctattaactaattcctccccctcttataaattcattttttaaatcctttatactcgatatctctaatccaattagatacatatggattgtattttattatggggtcaaacgaggaagcgattatattttttatttgcattagtggcagtccgccccttacatttttggatgggatgtagggaatggagggagtacggatcttttgtatatattgcttaatgtttgactagttattgccaggacgttataacttcagaaatcattttccacttttcacatcaattgaaaatatctactacaacctaaaatttt

SEQ ID NO: 109154 - DNA, 811 bp, Oryza sativa
ccgcgcctcctggttctacatgcgtgcacatgccacttttctaatagcttgtgcacaacacttgaaatttagaccattaaacacttttaaaaagttgtttttaaaaacattttgccccctagaattttcaacagctctaccttacggccattgagattggtcatatgatgagatctgatgtcatgtacattggacctgagaaacttgtcgagatagcacactctcgaggtcggaggggtttggtgccaacaccttagttttgagtttaatgttttttgcttctattatttttttctcttcttttgatggtaagcactattaaaaacatgtagtccgtacaatgcaccaaataaaatatatatatatatatatatatatattaattagccactcacagaatatgttgttcagttacaaaaataagaaaagaaaacatgggcaactttgaagaaaagacaaactcatttccgtggctgggaattgatcgagcctggctcgataggttgacattatcacatgagtgctcttctaagtaccaggttgtttctacgcaattgtctaactggtacatgaggtcagcccagatgacctgcagtttatgccaacacagcaagtttctctgttccaatgtacgtggaactaagatgttgaatcacagagttcaacctcgatagggctgaggctgaggctgaggtttattgtcaaatgatcaaaatttcagacataactaggtcacaaatacttatccttctaaaaaaccaaacctcaactatccccacttaaacgactcgtgaccaacgactattcttct

SEQ ID NO: 109155 - DNA, 3506 bp, Oryza sativa
caggccaggtatcgccatacgaatcgctgatttctagtgtatcgcagcatctgtgtgtcaagcggacacaacgtaaaaaataagtcccttaattaactgaggcccatgcgtagctatagaaggcagatcagacaattgattggtcaggcctacatgaatggctctatatatccccaaggcgattatcaacgattttagggctactatcacttaatgaagggatcactgatattgattttgcgcccatcaatacttcaagaattatcgacactattataaatggtattctatttagaataacctactttattgtagactaatctagaaacttaatttgatctattaagtactactctactcgttcattatatagctttcaaattttatctaaaaatataggtacttcatcgtctgatgtcaaacaatcacagcttcctcacgtgaaccaatcacaaccaaatcaatttagttccactgctctttaatctcactaaaaactctaatacttactatattttagatggaatatgtagcattgtattttttaaactggtaatattgctagaaaattatattgttagttataacttactagctttgtaaaaacaaattctccattcgatcatacatattcaaaattctgacaatcaaatctatattacggtctgttcactttgatgcaaaaaaaaaaccttaccaaattttaacattaccaaattttggtatagttgccaaaattttggcaagttgccaaaattttggtaggatttcttatatagttaccaaaatttggcagcaaactaaatgtagccattttttggcaactttaccaaaatttggtaaggttaaaaatgacatcaaagtgaacaggcctttagaaaatcttcctaaattctgataagtctataatattatgattaaaatttttgatgcaaatctacgcattgtttacttcatttttttcacgctactaaacagggttgtgttcatgctattgagggccgtaatttttgtctcgccataggccccagaaatgttagaaccagcccaggtgggacagcgggacaaggatgccgcccgggttggttgcggatcacggaacgaggtgagacagcaggacaaagatgctccccgggtttgttgtggatcacggaacgaggtgggacaacgggacaaagatgccccccgggttggttgtggatcacggaacgagatgggacagcaggacaagcatgccccccggtttggttgctggtaagatatgcacagtacgttttctctttcactagcatgttgatatatactctatcttgtcagacgcgagcatgccatttcgtgcttacagtaaggcgaaaatagtttttccactctccctgtacagtgttgaatggcataaggagagatacattgaaacgtaatgaacgaatatgaaaacgatcgaagcaacgggaccaactgcatgaatggcaatatcgcagaaacctgagtagggacggctaaaccataaggctagagcagcgacagtagcacaacctgtacgacacacaacggcaatgctcgtaatagacgaataagaaccggatggctgattataactagcgcagatgttggagacattgacgtaggaacaacaagacgacgacgagagcagtgatgctgcgctcgaaggcaacacaactatatagctctaaggccccgtttagttcccaaaattttttcctaaaaatatcatatcgaatctttggacatatggatgaagcattagatgtagataaatgaaaaaactaattacacagttagagaggaaatcgcgagataaatcttttgagtctaattagtccatgattagctataaatgctacagtaacccacatatgctaatgacgggttaattagactcaaaatattcgtctcgcggtttccaggcgagttatgaaattagtttttttattcgtgtccgaaaaccccttctaacatccggtcaaacgtccaatgtgacacttaaaaatttttatttcctcaactaaacacaccctaagtcaatgcagcaccccgcgactacagtagcccaaagcttgatgtagtacacgtgctcgaagctcatacatcccacgatggattgtcatagatggatcttggttgcccgatgatccggccaatcgcgcatattgcaattcaacagtgaatgatgcggcacaaataggagttgaggacagcgattttggaagacagcagtctgaaatcgtacggttgggaatgctgattgagcagatcaaaccactcataattacgataatttttttctaacccaaaaagtcaaaacgggttggatagtaaagatcgggtagaagaggtgggaatggatcgatcagtgcttgtattggaagtatagacgaggccaggagtacgtaccctagggactacaaaattgctacttatagtcaccacaattgttatcaaagatgtacttccacgtaaaaaggaaaaaaaaatttggcggaaaagagatgtccctccaaacatctatctatctatcgtatactaaaagtcaattaaacttcctagaaacacacttaagccgccacatgacagtactgtttaatctcaccgtcaattttcattaaaattggtgcacccgatactttagaccattagattagatgtattatttaaaaataatactacctccgtcccataaaaattgaatttctaaggaattaaggacatattaggaggacagacaaatgactacaataaccttgtttaatgaacacaatacatgcacacattccatatataaacttgattaaaaggaatgttgagacaatgggttagagatgggatggaaggaaagaagattacaaggaaatgcaatcagtttaatgggtcccatatcagtagaaatacaatttttatgggacaaagattcaatggtaaaaattcaatttttatgggacggaggtagtaataatattttcctcatgtatactgtgggctggaaaaagaaacaaattgtaagtaatccgtgtacgtacgtatgtacatacggaaaacaaacaatgaatcttatctcctgttcaccggaagaaaagaaaacatgcgtaccgacttacgtacgtagtgccattaaaggcaaagatccggcgaaggcagcgctggatccaccgcctcctcgctgggatggcctgccgttcgccacctctcccgtgcctgagatggggtgccaccatgtagaaagccttgctgccgtcatcatcgctcgcccaatggctttccggcggcgagctctggcaacggtgaggtgggggaggggggagagggaaggcgggtggcgctagggtattcgctccccgtgtcgccagcacgtgggcgacgcgggggggggggaccggcccacctctgacaaagattaaacctagattgatgaaaagctaaccaatagaactgtgcatgtctacacttttggccaatatcatcgggtgaagagctggttgaccatcgacgta

SEQ ID NO: 109156 - DNA, 1300 bp, Oryza sativa
gtttcgtcttgtgtctaatgttcaggaatatgcatttccaaattagtataggtatagatagaaatattcattatctttctttttttttggtttgttactaattcaggaaaccttcactgttactgtatcactggcaggtcagaagaatctgcaggaggtaccgacaaaatttcgggtaagtctgtcacatcttgtaatttcctgatggaaaggggcattcatattttggatcatatagtttaaatgcatcattactcgttagataaagataagctgctccatgttgttacctaagtgatgttgtaaatatctttcagtggccaataggaaaccccgacgcaaactttctaccttctgtacacctgtacaactgtttcgagatccaattaggccttattcggttacaaaaggattcaatccgggccgggaatgacaagtatagtataaatttattgtagatacaatgagagaccgggatttatttcaggccgggaacaaatttacccataatagggataataagagaccgggaatcaatccactaatcaagaggtgtgaaactaatctggatgttttgttatacctaatatgagtaaattggttccggaccggaaataaatcacggtctcttgttgtacctattataaattccttgttatacctatcatttccgacctggaacgaatccttgtgttactgaacagggccttactcaacctaaaacatattgtatcatctctaggacatatttcaaaacataaggtgacatttgtttcgttaggacgagacatggaccaaccatatatagccagaatagaataaaaacttttgtgacacgaaattttatttactagattcgtatctaaaattatgtcgttatgattatgttttgtcacgtaactgatacatcatagtgctgtgctaatagagttatagttggttaaagtatttgttacactcccacttcatcttcaacaaatcaacacaaacgcattatatggcaccaataattctcactagatttctcaagtaacttgggtaaaatgcagcagaatgaaataagggggtgaatagagcagttgctgctaggttgatcctcttgtatatgccaggttgctactaggttgggcctaacaggcctcttctttacatgcgatatagcccagcccatgtaagtgatattccttcccacttaaaaatcagcttgtcccaagctgatgcaattgagcctgcgagctgatgcaatttcccaggatcccatagccttgaccttgccttttctccaacatcggcttcataa

SEQ ID NO: 109157 - DNA, 644 bp, Oryza sativa
ttatatagtaccctctagtatatgtaccgaccaattggaaagctcagcacgaattttatatgaggtcttaaaattgacgaagacatgtattagtgttgttttcttgtgccgctcagcacggatagtcgagaaaaactaggtagcgttaaactaaaactaagaaataaacgtaaaaaatttatcgacgtcattaagagtaaaacctatattttcaataaaaattttactcatagttaaatctgattagataacgtggacaaatctccaacatctatccaatggtagttttcagattattttttattacatatgatttgcaccacatttttttttccaatagtcctcccagaccagaatatggtggctggcggatagtagcgggctcgcactgacgcatgcactgtcaccggcatttggtcgtgcacaaacagaaaagccgagaaggccggatggtgcattgtgtctgcgggtttgatgatccaacaaatgaaggaaaaagttgacgaggcggtgatgtgtgtttgctgggccggatttaggtaatgctcgagatcgacctttcgatctagtaaagaaaaaaaagaagactattagtgccagtttggatcggaggactaaaattttagtccctatcacatcggatg

SEQ ID NO: 109158 - DNA, 821 bp, Oryza sativa
tacatattcaattatctgggtataattggatctttgcatagttgtctaatactaccttagctctttgtgagattttttttcatttttttgaaaactttatattgttttttgagatgtaaaattaagagatatatgacaaaaagacaaaaaccggaatagcgtgctttgttaatttatatctcattaacaaagttcagattatccatgcaaatttgtcggtttgtttatttatgtatattacctagacgtgttatacctttttgagattttctgagaacttctataaaaaatatgtccatgtttccacctaagatagatatggttcccaccgtatactttaatttcctaataataaactagtccaaatataaatcctcaaaggaaagtttaaaaattgcggaccatgcataaaactgttcagtaaaggataaaagtttaaaatgacggcggtgtgtaaattttgcgaggacaaataactcaatccgtcaattttttggagcacaagtgaagaatttctcaaaataatactccctatgagccagattagaatattatatgacatacatgtttttaaatggtgtttgatattataatttgaccaataatctccttcacgaaatattatgagatattatcaccaattataatattaacatcacatgaaactattttctagagtggatagaattatacaacatgcatgatactgaatatacatattattagcttaacgattattaaggagttagaaacgtttaatttcctaaaattgtcagcatgcatcttctatattttggacggagagtatggtggtatacgta

SEQ ID NO: 109159 - DNA, 1321 bp, Oryza sativa
ttgttgattgcccgtggcttctctggttagattaatatttttttcaagacattgtgctagaacatctgactgattaatgactccgacgttggtgactctttttgggttagattcatcatagtagtctaatttctgctataaaagtttactccctccatccaaaaaaaccaattcttttttgggttcaaacctaggataggggtttttttttggggggggacggaaggagtatatcatattttactgtaggggagaagtccaattttccactcttttactctgtcttcaagcaacatttgttggttattaattttgttttgcttcctctctccatagtgcaatgaagctaaaaagtcaacatgaaatacaaaacggtgtgtcttgtgttaaatcaaaagcatgtgatcgctgcagatgttgattttgatgttatatttgattcaaagtagttcaactgttcaatttgtcccttgtactttcttttgtaatgaaatcgctggatcattccgcactgtggttgagcctttaattggatgttatgtgtattatccgacttaatgttaggaaactagatgactttaatatattcaatggcactaaagtgaaccatctttcgatggggctccatgttaacttcatgttgtagtgcatgtacttatcttttatcttttagatgtttggtatgatttaaatttgtggagtacggctcttgtgtcagcataataatttatttgctcagtgtacaacaatgtatgatcaaatcgtatggttagattattttatgataattagcataatgccctttgcattgcaatcggattttttttttaagaaacagctcattgtatatatattttaaagcctctaaaacaaggtattcctactgtcaaatatatcatcatcatgctagctttgttgtcactttgtaggttgttgttacttcctaagtaaaaaaattacattacagtagtattccattgtcatttttctctgtgggtcctgtatagggtagttggaggtggtggtggccgtgacagacttaccaccaccattaccatgtcttaaagtcgatgtgatttcatataaatagatgtgattttgtataattggagaaaactttgatattgtttacgtgctttgcatgtatcagatgaatgttactctgtttgtctatttacggtgaaatatgtttaatttcatccatattgacaatttcgtatatagtacgtgcatgattactagtcacctctataaggcactctgagaaaaactaacgcttaatccaatgtgtcgagtactctcacctctataaggcactctg

SEQ ID NO: 109160 - DNA, 639 bp, Oryza sativa
agtcaaattaacatgtcacaatattcatacgtgtgatactacgcacgaaagtttgaaacagacgagcactcgatcgatcgatcgatgaaatcctgaccgttgatgcttgatcgtgtggatgtacgcccgatcagcctacgtacgtgtgatcggcggtgtgcaaattagtcctcggaatggctcgcgcattcacaaccagcactgggatgcacgcacgtactgcgttacacgtctgcattcagttgtggaatctttcatctaggaccttacttttgagatatattacattcagattcagttctttctctcctcctttctcaatttcttctccatggttttttgcgcgcgcattttttaaattgcgaatcaatgtaattttttataaattatagaaaatttgttttaaaaatcatattaatccacttttaaaattttttaaattaatacttaattaattatgtgttaatttatgcttcgtttacatgcttgaaggattatttcccaaactggtaattcttacttaccttagtagttaaatacatgactttattcgtatttaaatatattactttattcggttgagtttgactactatgtttttattagaaataacgtcattgtataaaaaatatagtattg

SEQ ID NO: 109161 - DNA, 914 bp, Oryza sativa
tacgtgggtttgcttttaaaccacctaattttggaggcccaggatgcaaaagcttaaagccatttctaacactgtgatgcatgcaaggcccagagtagaatacaggaaaattctttgtgactctgttcttcaaattattgaattggtcgatacaaaattctttacagaactcatgcagaatcattttcaaattaaatgggaataattcctttttaggacggatctatttgttttgctagggaaataatcatatagatttgaaagcatgagagatgaataggatttcataatacaacaaaaactgcttgactgtcatggttgatcttatcgagccaatctatatttaagaaccacttgataaattttcatgtattaaaaaatccaaatatttgatacattccgtttgaattttatcagttttcgccattaatcgttcggctatcaaatcatggtggaatgcatgaagattgaggactcaacaaaaccgtgtctggctgactggctagctaccaaacagtcaaactttggattcaaacttccaactttttctatcacgtcaacctgtcatacacacataacttttcagtcacatcgtaccaatttcaacccaaactttcaactttggaaggaactaaactcagcctaggaaatctgaagtagtacaaatctagtactccctctgtcccataatataagtgattttgactttttgattgcactgtttgaccattcatcttattcaaaaaaattgaaattgttatttattttatttgtgacttactttattatctagagtattttgaacacaacttttcgttttttatatttgcacaaattttttgaataagacgagtggttaaacagtgcaagcaaaaagtcaaaatcggacggagggagcagtacactacatccat

SEQ ID NO: 109162 - DNA, 1270 bp, Oryza sativa
tcaccttgatttcaccataaaattggcttaaatattggcataccatgtctcatattttcagtttggtatgaccaagtattttgctgaattctgaacgactatgtggaatggctatttccttgtttcatgtgagcacgttcccgaattgctaactaatgtattttatgtaaaaaaattttataggtaagtttcttaaaaatatcaaataaatatatattactcaattaattatgcactaataacttgttttgttttacgtactataaaaatcacagatgaacctctgttttgaactcagccttaagctaaaaccaaaatgaagaacacatttaatatatagacataacctagttagttagttttggttctgaccacatgagagcatcaagcaaatcaacctaaaaaatgttcatgttgttttcctcatccaaataccacaggctgcccaatgcttgggctttttctcaacaccaaatggacaaaagaggcttcccaaaactcctattagccattcatcagtttcaaaaaagtctccacagtagcaaagagctaatataaaaacacaaataagtcacgatatcttgtagtaaaattattattttttaccaggctagcgttcattttggcatgaacaaaattttaacttcaaacattgatcatgtgcacatttcctataaacatgacctagctagttaatttgaatttggctcaacacatggcccacatgagagcatcaagcaaagcaaaccccaaatgttcgtgttgtttacctcatccaaatttccacatgttgcctctatgcttggatctcttaacaccaaatggacaaaagggattccccaaattaagtttctagtagccaattgatgattaatcatcggtttcgaaagagcgcccatggtagccacaatcctcgtatgattgtaacaattaataccacgacaatttcatcacctcggtctcattttcttcaaccacatgaatatatacattccgtagttatattacgtgtaataacaaatatcttctagcgtataagaagccgattcgcacttgtcaaactttattttaaacggaaagtctaaatttcaggtgactgaaataaagtctctttcttaaggctgagttcaggctgagttcgggatgcaaggttcccaaccttacctcttaaaaaataaatcaatataattttttaaagtgatttttctatagaaaacttttgcaaaagacacacagtttaacaatttgaaaagtaagcacgcgaaaaacg

SEQ ID NO: 109163 - DNA, 649 bp, Oryza sativa
ttaatttcagaactaattttagaatgaaaaaactaatttcagaactcgcttggaaaccgcgagacgaatcttttgagactaattaagccgtcattagcacatgtgggttactgtagcacttatggctaatcatggactaattaggcttgaaagattcatcttgcgatttcctccataactatgcaattagtttttctttttatctatatttaatgctttatacatgtgtccaaatattcaatgtgatgtttttggaaaaaaaatttggaactaaacgggcccatagtctcgcgcgcgcgcacacacgaacacacttagtacacgaagtagtagcttgtatgcttaccccgactaagctgctgatgtcataattaggtttgcaaatggcaatgacgtcaggatgacatgtcacatgtcgcttgtgggcatatgcatgcgagtgtgggcggaatataatgcttgtccaactagagcccttccagaaagctacaatttcaggactaattctataaaaaatgatgaaagaaattactattttttttagggtttgtttaaatggatgccattttaaactataccattttaatagagttggtaaatatatgcatccatttagtttcttgccaaactttggtaaatacataagaaa

SEQ ID NO: 109164 - DNA, 510 bp, Oryza sativa
cgccgcctgcctcgctcgctcgttctcgacatgaacttgagggggatagacgttgaggcagcggaagagggacggagcaagcgtccgcgtgtagtggtcggcaaggacgggcgggtaggatggcgagctcgagctcgccggctcccctcccctctccctctccaatctcggatcttcctcttcctctcggctctccctcgtcctcacgacggagcgacggcaggccgtgggcagagcggaggggcgggcggcgacctcgccaaggatgccgcgcgcacctccgacgcgagaggagcggcggcgcgcgccggccggtgggagggagggagaggagcggcggtgcgtttgggtcagcggctggcgggagggtgagagaggaacggcggtgcgcggctgccggcgggagagggtcggcggcgcaagccgactgacgggtgggagggagagaagcggcggcacgcaccgcgccggcggagagggcggccgacgggaggggggaagggcgggccg

SEQ ID NO: 109165 - DNA, 640 bp, Oryza sativa
attcctgcagcccagcaaatattggagctagattacttgaagttcaaagtcccgttgtttcgttgtcgatgggtcgatcttcgcaatgtaaaagttgacaatgaaggtttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccacggcataggtcaagaaatacccctagaagaggaggaagaagaagatgaagttcaatatgcacgcgtcgaccatgaggaaggattatttttgtaatttatgtacatagtttatgtctacatgctgttatctgtatgattctaatatgttcgcaatgatcgacagtatattgcttatgaaatagtcaaataaaataattaagtgaagcacccactagaagtgaaataaaataattaagcaagtataaccattggaaataaaataataaaattagtaaaataatgtagtgcaattactactgttagtgaaataaaataattaagtataacaaaatatgtagtgtatg

SEQ ID NO: 109166 - DNA, 646 bp, Oryza sativa
ttttttttaaaagaccttagcaggggaggcccccgctgttagaaaaactttattaagaaaacaagaacaaagttacaacccattaatccaacttatgattacatcgtgatatctcgcacaaattctaaacaatagaagggagaggtcacccttaaagagtggcctccaagggatgaaagaagggatctttggctaaaaaatgaacccatttctttgtttccttttttgccaagcaacataaaggaatttctccatgaaacagctcccctgataatccaatttagcccttataaacattgcttccaacgacagagtagtatcccatgtaatgcctagaagactccaacatttttgggcaaacgggcataaaaggaacagatgcatgaggtcttcaacagctgccgattgacaaagaacacaagaaacatctcaatccggaggagcacatttcttatgatccagcatgaacttggtgtttaatctattcatcatgagtagccacccaaaaacctgctttgcacttccataaccatagaaaatgaactggtggcttaataactctgaaattcagggcatagaatttttgtgaagaatatttcatatttccccaaatgtaagaccaaacatagaaaatgagctgcatcgg

SEQ ID NO: 109167 - DNA, 2388 bp, Oryza sativa
ccaaggcccataccttttttggccccccagaaaatcccctctttggatgggcacccacatgcccctgtcaaggaggggggcagcaatggttcaatgattttattcatccccagccatccacgggatcggagaaaacgggctgcacgaattgcatgtacgttgtatgaaccaaacgagttggttatcaaaagtcttcggtcttaatttattgagtggctgaaatagtttttatcccagtagatcccatgaaacatatagggtgaagatacttttatttagaagtttaggaacacctgcaagtattcatgtgtgttaattaagccaagagttgacccctgatctcttaaacaaaatatgctgctatataatgcacgctagctgcaataccagttcacacacgtacggacacattattgaggaactatcgaaatggaatctttccgttggatattaaaaacagtgaatgaacacctaattttacatagatagtacacagaaggaattaatcataaaaatatgaacatacaaagatagtggacaaaaatatgaacatctggctagtaacaactacactttttttttaaaataactgaaaacatacttttgtcatacaacacacataaaaaacacttttgtcatatatatggcacatagacaattatataaatagtcgtgcaattagttaattaactacctacacagaaattctagtatattcttcaatacgtacaacacaatattcaggagattatttctaatgcagaatatatatataaaagaaaaattctaaataccctcctaaactttgattggaagtccatctagcagactgaactttatatatacaccttaaattgtacaatatcgttcatattactctataaggtggttttcgcaaagtgatctttacctaatttgcatttatgttgggtgggtttgactaagtgacatatgaattggacatatatgctaaaatctccatctaaatgtttcatttttactctattttttgctctcacttacaaaggaatgtcaatacatacttgtatgacattacaatagagtataaatgagtgaccagtgattgatgatatgtaaacatgctatattaataatttaaaacctctcagcatgcaaacttccaaatacacaaaaccaccttagggagcaatataaatggttttgaaaagtttaggtggttaggtgtgtggttttaaagttttagtgtgctagcttagacgaactcctatccaaagtttagggatatatggacctttaacctagaaaatttaatattaaaatcatatatttatctgtattcacgatttaacgaaaaggtaattactacaagaatccagaattttcttggctgccaaaaactgccaaggcaatatattttgatggccgaacgccaagtctagagtgatagggaaattcagatttcttggctgctaaccgtgagggaaagttttattggtggtctaactgccaagaaaactatgaaggatatcaaactttcgaaaagccaataaatgtaaccttgacggctattttttgaccaacgaaaaaatcaggtggcgccaagaaaatcccggaatcttgtaattgaataaaaatccgtcaattatagatacaacatagcaaaaaaaatagtagaaaaatatgattgaatatactaacatgcagattgtacacacacataactaaggtataggttttctttttgtccagactagccaattttgacttagaaagaactgtaattgcacctcttttctagtctagatagtggtgtacaggttcacatatgaagttaattactcaagaatatttcaacaagtagttcaccgaaggacgcatatttaaaaagttcattacttttttaaacgttacttaatattttatgcttaagacaagatttgattatattttataactttgaacatcaaaagcttctcaaatacttagttttaaaggaaaatatgtggtatgtatagatttgcgtggaaaagaataattataatatcataaaattattgttttatgaacttatttgacacaaaattgactaccaaagtttgatttcaaaatttttgactactttttatcctaaacgtcaaatattatgactagatggggtcttgcaacgacgctagcttgaaactggatatgattacattatatggccttggtcagtaaaacatttgacattatttctcttattatatcttaccttttcagtgagaaatagatttttggaagtgcacagaaccatggaaccaatatttttttttaaaaaaaaagacaaagaaagttaatgtattccttccgtttcataatgtaagactttctagcattgcacacatacatatatatgttaatgaatct

SEQ ID NO: 109168 - DNA, 794 bp, Oryza sativa
atatttcttttcccacaaaccctaggttattaaataagagaatctgagttcttcttacttcgtgtcactctatccagtacaaatgaattaacccctacttagactttgatgtatactggtaatatataaattattagcatagttctctcttataaatcttctattgggattaaatacatatgatacattggaatacttccgggtgaaatgctaaaatggtatatccgtgtgcttgcggattacatctgtaaccattaatataccaggattatttatgcatcattgctgggaatcatattaccagtagtgtcgttaagaaatacaaacaattcacaaactgattgtggttccccggttttgtacaccggaaaccccatatgtcttacaatatcactccctggatcagtaggtggtacacacatggcatagtcgaatatcacaagctgacatcgttttataggtattgtactacattaataatacaagggttactcaactaggaccccaaataaaccgagcatggtcatgcacattacaaaataccaaatggaatatagataaaatagctgaagcgaagcagcaaaggtccatcaaattccataggcattgactggtgaacctagatccctattcctttgtcttcgacacgttttcaacagcatagcatgcatatggtcgactccaactcctttctaaaagttttaaattaagtaagggtgagtacgaacgtactcagcaagccccccctacagaatgcatctagtgcacacaggggttcaaggatggctgggttt

SEQ ID NO: 109169 - DNA, 6042 bp, Oryza sativa
ttattctcgcattgcggcacccgctccaaggactatgagccccatcgcacccccggcacaccaaacctacctcgagccggaagtgaggggagtcctggcgctcccgggatcagggtatacacacacacacacacacacacacacacttatagggtgcattttaggtttttaccggtattttccaatcatcaacacttcaacaacaacatcatactcatacataacctaccatgactggggtgccaccccacaagaatttcctagtccatcgggtctacctatttgtaaaatgcggtcgtactcgattcgtttcctatatagcttcctgacttggtccttaactgaccaaggtcgacgactaaccctttctagaaccacccatattctgacgccttcaccaacgccgatctatagcggttgctcacgtgtgagcgctatcgtccgcccctctcaaatttcgttgttaacagcccccctcctctccgcgccaccgccatgttgccgaagaggaaaactaggaggctgggaagccttcgagctggaggttggaacctcctttgcgccgttgcccagttgcatgagaggacaaagaggaaagaaagaataggtgacatgtgaactaatggtttttcgtttttattccttttcatttacttgtgggttccacatgccacgtcataggtagatgaagtcaacacaccacatggttgcagtcagctgaaacctctattgaaatcacattaggactatatttagactggtttagtaagatgagtgacgcattatatctggtattatggtataggatatgatctgaacttgatgtcaagatgaaggatctcaagtgagcttattccaaataaaaacctttgcctgaagtcctgtgaaattcgtcctgtccaaacagggtaaattcttggggacggaatagatatagctaaacggaataagttcatttgaggtcccttaacttgtcaacgaatctgattttcgtccttcaatctaaaaaccaaatacaacgggtccctcaattatcaaaaccggtgcatatgaggttcctcggtggtttagatgacggttttagttgacggtttaaaaaggcaggatatttaaaatgatgtgtggggctagggggccccacaatttattattagagaaaatccatgaaatgccatttgcaaacaccctaatcccagaaataccatcgacaaagacaacttcccaaaaatgccattgcacaagcctctttctcctaaaaatgccatcaccgtcaactccacactgttacatccgttatttttttttataatgtccattctgccctcagtgcaaaatatactccctattttcactgtgaggaaaaatgctgagggaaaaagaaccctaacccaatcgatccggtgaggaggcacagcggttgctcggcgacgacggctaggtggtggtccacggtggtggagccgctatgccggcggtccacggggggccgcgcggcagggcaggcccagggcagcgttgcagagaggaggccaagggcggcggcacggcgagggggcctagggcgcggcgaggaggcccgcggtgccggcacggcagggagcggcgaggaggcccacggcgccggcgcggctgcgagcggcgaggaggcccacgatcgcggcgctgcagggcgcgtcgacgcggttcacgacggtgtggcggtcacagcctgcggcgcaggggccgtaggcgccggcgaggagggtaaatttgttttgcttcttttaatgaatttgaaatctgcaagagatgaactttgtgtgtggatagtaggttgattcagttgtccttgctgtttttgtgtgctttacttagaaattttaggtatccatgattcacaatcgagctgagggggtgatctatcttactgaactttcatgtgaaatagagatgatggagaagtatatgtttcaactgaacttgtctcggaggcgccagcgaggagggttattgatagctctatttttttctcatatcacaatcctgattattgataacaaaatttctgaaagaattgcaatggcaaaatgtgtgaaattagtttgtgaatttaattctgaaataatttgattgataacaaaataatgatgtctgtgaatttagttgtggacagaaatatgtatgaatgcaaaataatattgtgtgagcaaacaatacagaatgatgatgtgtgagcaaatggatgcctaggggtaagattgtctttttatacaacttaatggagaggacttaacagcacttatggtgtgatggcatttttgggagaaagaggcgtgtgcaatggtatttttgggaaattgtctttctcgatggcatttctgggattagggtgtttgtcaatggcatttcatggattttctcttattattattattgtgtgaaactgacatgtgggccctacgagttttttccggttctaattaccacataaacgccacgtcaacgccacgtgggacgatgacctagtcaaaggatccatgtagacatcacgtcagccaaaaccgaagatcaatgctgccgagggacattatttgcatggttttgaaagtggggttttgtaagtagagggatgttttgtctttcgtttccctgactgaagattaacaatagactgtgggacaagttgagggacctaaagtgaacctttatcctacctaaaataggcttttgctcccccctacttacaacacgtccggcccaacccaatggtttcacggcccacagcgaagggaccggccgccgtttcgtccgcccaggcgtcggccgcgtcgctgcgctctctcctcacgcgcgcagacatcgacgccaccaccccgccaccgcgcacgggggcggggaccggaacagcagccataagaggcaggtcgcgacaacccccaagcgccgtcgccgtcgagggcggccgacggctcccctgttcctttctgctccgttccaaagtggcgaaactaataaaacgaaaaaggtgagtcggtgtcaatccacctccgacaccacgccaccgcccgtccgtctttctttctcctgttccttgtccggggtggcgcaatgattcgcccggacacgccccgccctcggcgtccgttcccttaccgcgcaatgtagaaaccgtgcaggaatcaggtgccccttccggtttggagatggtgaaaaccgacgagaaccgggctgctttctcggtgtcgtatggtggccgtttgttgccttgctgccggtggggcgtgaggtgaggtctgtcaactactcactacgggggaaagggggagggtgaagtcgttggaaatttggtcggcagggtgaattcgtccccagtttaatctgttagattttgtttttaccgaacggtagaaagaaactgttatttctctttcttgcttattattagttattatcattactatcccaaaatgagccgactggttattctgatctaactaggtcgattgtttttaatgattgcatatggtgtggtctagaccattgatcggcattcttaccctgctggttagctttatcggtaagggcacccgcaatggttatctatatgctatctacaagagattcatgtcagcatattttcctacatggaagagattaaatgaagagagagagcaaagctatctactaacctggagatagtctatagagaaaaacgagacaatagattagagagctatagatacccatataaacatactattgaggcgatttactattaatctagtctattgttgagatgtacatgttttatagagagcaccttattttatcattatgggtgccctaagcaaatattgtgacagaaactggttggagttgttacgttgtattcatttggatcacatgtttcaagaccctagcgttgttactgtaacatttactacagtatggaagtgatcttacgtcttataggctggcatttttatgtatgaatcaacacactccagacttgtagcaggtggctgtagcatgaagtagtcttacataaatcccttctttagtaatatatctcttttacactgtattttttcacagaaaagggccaaaaccaaggaggggctcatacagttctccttttttttttttgaacgggcttatacagttttgacacaaacaggattccccaaaaaaatatttgtgttgataaatagaataatagataagattagagtagcattatgctgcactggtaaaaatacatctgagcaactgtagtgtgtgcattttattagctttaaagaactaaaactacagttcattcttgtatttgtacaagtcagaatcaattgttctgtggatttcttatccaacacgactttggctgctgggatgcgtgtgtattccagattacacagttatatgattctaaatagcacattgttttggtgaccttgcagcttagtagttgtaataatagagacttataactcttgcagtatgttgtgctcgccaggttgaaacacctgccaaacctgttatgggactttcaactccatggtctgagtgcagcagtgcgacacacacttcactttacaaatattatctgtatagtaatcttgatctatcttaaagttgtcctcgtgatcttacacaatgtttggctcattagtaggtgatttttcattttattctccataaaacctataattactattattttcagagtcttccataaaaggcactaccaatgcttgggagggatgtattttactagatcacgagacgtaattacagtcacaagatatatttactacttcaagtgaatgtgtctacagtggcagtggcaaagtactataactctttcattacaaaatgaggagaggtgtcttggattcaggaaatgtactttatgtttatatggtaatagagatcagctatgtacttttatctttcttcaaaattgaaggtattagtccatcaattgacgagcaataaataaatttgcaagatggcaagtttggcaaccatttcttatggcttcaattttcaacatggaaggatcatgttggcaataatcttctggtcttctaacgacgcatcaattgaaattattaatttgaatggtaagtattggtttgcaggtaaatttctgttgacatacatttttgtatgaaatggaccctccgtcccaaaaaaaaaaaacccaatcacaagttcgaatctagacatagtatttgttcagattcaaacttaggattaggttctttttggaacagagaaagtatggttcagtattacttagtctatcggcacacagcaattcaaaattgttgctgacatgccagttacaagtactgtgacttcaaatccacctgtgatttgaaactattgcaaatatgcatcctttgttcagaattttgtctaattatgtgactgcagtttgaagaatattgagaacaaaaactgctacaatgtttatttctttcattcagttgttttattttgccataactagtattttggaacagtaaagattctttttcccctttttttataaatgtgtactttcttcaatagaacagttctttctgttgtgaaaaaagaagaaattttgctactttcaacatttaaacctttaattgtttgttgtttctaaattgaacagaaacagttaagtattgttggaattcaagaggtgtttgaaacatgtcaatcataactgtgcaggactatttccatcaagagaggatgaagctatgccatataattgataccactatttggttactaaggcaggaaaccttcatcaagccctatattatacttccctttatccaagttaaaggttgtgttcctacttcctggttctactgaacttcactggagcctgaaatcatggcatacttatttctgtatctcaaagcaaatgttgcacatgaaattttgaagttgacatcactaaaatgctcaaactgggttccttctttcgtttttaccatcagatgaccagcgtaacttacaacagagactttctgtcactgtgtataagatatttagatttct

SEQ ID NO: 109170 - DNA, 2084 bp, Oryza sativa
ccaccacctcgccgccaccggttcctccccaccgctgtgggtctcctgcctcctcccagcgacgaggctgagggtggaaatgggaatttctgatgggagccgtgttcatgaaccacaacgtcaccaacgccgatcctaactccgtggctcgacgaaatggaccaaggagcggagggaggcgcgtgcctcgcagagttgtcacgcccctctgccgggagatggctccgacccaaaaagagacgtccggtcagcggtgtgagtaggggcatgggccaggagtacccattgtacatgggctaataaaaatgcagcagtcgaattccatgacatcgtcacttttagatttgttgtccccatggccttatttcgtaatgccttatttaaatctttttactcttgcgttgagttctttttagagcactttggaagctatgaatgtgtgtaactagtacgataaggtccttgacacacttttctttgttgatgttattgtttgaatagctgtcttgagaaaaagctgtgcggttgttgattcagattcatgtccatgtcgtaatagagcttttgtagtatttgaaatttagtcggcgaggcgtgagtgacagctgtttaaccagttggttttttacgttaacaggcgcactattgcatactgcagagcatgtgttagtgctacaagctggagggccccctcaagcttacacttgcgtccttgcccagctcaacccgttactttttggctcatccaatctcttgtccatacgcaggtacgttctgcaatacttatcctcataaagtctggtctttttttcttttatttggtttcaagtaatccacatgtgaacctcaatttgatgcctaaaacgagggttttccattggtccaacgggtttcccttttcttgtgatgaaagatacatacctaccattggtaggcgacgattgtgatgttagcatggtactggaccgtatgatctgtgtagcaatcggtgaaaggtttcatgggaaatatctgtataattttcctgaaggaattaatctgcatttttgtcacggcaagatattaccacacctaaccgtgactgttgaaacaacagcgcgaataagcatccgtaaagtagacaaatagtatgttgagccaagaaatcatttaccaccaccacctccctttgctctcgttaaaagagcatcgaacatgtagtatacactgcgctttcctgttttgctgaacagatatatacaacgttacgcaggcacgatgattcctccttcaaacacatttagcaccgaacagtcttgcctgtgtctgctgctatttcactaatcgtctcctgatgctgaaattcctgtccagatcggtgctctccccggtcttcttgtaaaacccctcgcgtcgatcgtcatatatattcggttttacagctagctgttgcagatgaggaaccgaacaaatgcagctcctgtagcacattccgattgttcgggcgtcgcgtggcagccagaatccatccacatcattgtgccttcatcatccactcatcaactctcatcagtcggaggcacacggcgctttgatttggcaagaacggctgaaaaaatgtgatgatatatctaccagttctctcgtttgtatacaatttcaaacgcaaaattgttgtgtgacgagccgtaccagggatggcacggcatcttttctgtgtgggtatgtatgtgccagtagaaacaggggctttggccggctaaagttttgccacctgatgaggcccctgttccggagccatttcggcactgtgggtcgagaaagaaagcgagcgtgggactcccgtcaaggaaaagctacgtacctgaaaaagtcccacggcaacggaccatgctaatcgtgaaactgccggccaccacccttatcattgcccacaggttgatgttgacgttgccctcctcttcttcacctcgatcggctactattgccccagctccctgaatcttgatccctctgatggagaacttcatcttcacacaaggaaaaaaataataaagaaactaggaactcgaattctccttgttgcatcaaccacctgaccgggg

SEQ ID NO: 109171 - DNA, 1650 bp, Oryza sativa
tcttttttatcattcggttgtaatgaattaggagttgtactcttgctaccatcatcttcttcatcagctctctaagttggggtcaaagacttctgggaacttggcctcctgagggactccaatgcttgaaactttggacaattattcaattcctcaccttgagccaagaatgattaaactgaaatgccttaatctttttttttcctttgatgagtacaacgcctctgcttcaagaacctgcagcaaaactcaagtgttagttcacatacataaaaaaattaaggttgtgttcggtaaatgggtttgggaactaatcttccatgcatggaaaacagaacgatatattagagcactattaattaagtattagctaaaaaaacttaaaaatagattaatatgatttttaaaacaacttttctatagaaatttttgcaaagaatataccgtttaatagtttgggaaacgtgcgcacgataaacgagagaggtgaagttgggacaactgggtaccgaacatagcccagttcgtatagggatgggggagtgaaggcaacatttcatactactgaatagacggacttccgtttttcttttcacgaaagatgggcttaattgactaccctcgcctctcacctctccaaacatgtggccgggtggagagctaggagtacatggcggtgacgatggcctagaggtgggggatgagagggtgggagcggtagggtatgttgtccaagctactgaggagatttgaggagacggtggcggcgtaacggccaaggaagtgggctgggaagaagcacaagtgcgcctccacatctgctgccgccgagactgaggtgggagagaaatcaaagaatggggagagagataaggaagaatacattgtttcactgatatatgtgggtcccacaagggtcttttttttatttttgattttattgccacgccagcgccacatcatccaaaactgcctttaataccgccttaggaccaaatgtaatccggttttgtaagataggaatgcattatactcaggtgatgattttgaaactcgatgacaagatgagaggcctcaagagaacattttccttctctaaaactagaccaaaatttccaccgggcttttgagctaggaaaaagtacgaattaccccgctgaactgttatggtcgactaaattacctcctgaacccaaaagccagatattgctcaccctaaacttttaataccagacgaattacccccctcgacactgttctaagcggttttggtttgagcttgcagacgtggcgctaacgtggcaatccagtcagcaaaaagactccttgggcccacttgtcaaatctctccctccccctctctctctctccctggtccctttctctctcctaagcgccctctctctctgttcggtccctctctctctcagagagccagctgcggacgagctcgggcacactggtgtggacgggcagtgggcggtgtcgcgtggggatgcgcggtggacggcgacgcgggggaggacgcggcagcggcgggcagtgccatctcgagctccgcgtcaacggtgacgaggcctatgcagggggcggcgggcacaacgcaggaaggacgcggtggcggcgggcggtgccctctcgagctccatg

SEQ ID NO: 109172 - DNA, 1391 bp, Oryza sativa
ctattaagaggagttctaggtgatgctctgagatatgtcaagtgctcttagtgtgaaccaagtgtcaagtttccctaggagtcatttttgcaaatactccatctgtccaaaagtgcaagtccggaacttcctgtcttccaggtccggaagttctggtcttgtgaaaaagattttcctaagtgtagtccagaagttactatcttccaggtccggaacttcctgtctagtttccagttcaaaattgtgagtaatggctagatgacgtcacctagctgttatacataaccaactcgttccttggccattccactttcacttttcgaaccaagagctgttgctagtctctcccaagtgtttcttgccttctccactcaatctagagcctaattcttgtgagaaagagagattgagagggagagaagaagatttggagaggtgtgaagactaggatcttgggtgagcacttggaatatctcgtgagctgtcatctcggtgcttattactcttggagatgatctcctagacggttaggtgtcgcccgcgagaatccgttgcatattgtggatgtcccgggtaagattgtaaaggatctcccctcctccgaaaaggaactaggtaagttaatgaagttcttgtgctgagattctagaggttttccaagtagagcaacctacacttgtgacgaatttctagaagtaggttgagtgggatcttggtggtcaatcaattctagaaatttgcctaggggtgtttgtcgttgaaggctgtggatttcctctggggtttttgcacaagtgaggcaaggggttaattgagacccagctctttggagctcctcaagggagagtaggatcgcaagatccgaacttcgggaaaaaaatcgctcttgtctctttctgtgatgtttctgtggatgtttctgtgatctattctctgctcagaatacctgtgcaccatcttgtgaagattggcttagtctcctgtttcgaaatttgaattccatcctttgttttgttacccggaagttcctgtcctagaacaccggatgttccgagcctggcaaaccggatgttccggtgttctttaccaggaagttccgggtttgtttgaattttaccgctgcgatttgcttttaagttttcagtgacaacctatccatcccccctctaggcttcaccagcacgttcagtagacgccggcccgcgccgcgtacgccgctgaccacaccgagccgtttctggcggcttcagcctccatctccgcggcgtagtcgacgctgtcggtgtcgtcgtcgcccatttcgctctcgggcatcccctggttggtccccaccacccctcctcctcctcctcccccttctttttccttaccccccgtttcccaaaccaaaa

SEQ ID NO: 109173 - DNA, 565 bp, Oryza sativa
atttggggacatgtagtaacaacactatgatgattattactgcacactcccaaccgttttactggattatcgcaaatcttttactacacgggtattgaacatcaccaagaaaattattgattactatagtaacctgggacacaccatcattaattggcatgagtaggaataaccaccatgctattgattattggtcataccactgaccattcctaaactatagtttttactctcgcacgttatcgcaaaattggactgtgttactgcgaacatgtgataatatgtgaaataaatatagtaacaatgtactaatgtgtagtaacagagtaaataatatcccggtctctctctccctctactctctctcctctcccgatctctctctatctcgctctgcacttccacagtagaagaaaaatagatacgtgattacaaaactcacaagttactttgtttcagtagtaacattatcatatatgtacagtaacactattcaagaattgcagtaggacgctttgttactgtaaaacttataaaattaaccacactttcgtagtaacgccat

SEQ ID NO: 109174 - DNA, 1567 bp, Oryza sativa
cggtctcatcgcgcgcggcgaccccatctcgcttagcatgcatgcacgcccaaacaaacgcctacttttgcacgctttcccgctgctcccgtttcgattggcgacgcccccctgccctgaccccggaccccggtcggacccttgcatgcatgcacgatgcctatgcattcattcacgtacggtacgggcgcacacgctgttgacctgacatatgatcaagcaatatatatgtcgatcgaataatttagcatttgcatgctagtagtacccatgccacccgtagcgagccgtatgtttgcagggataatatcgtatcatatcggagttggccttttgccaggcccaaacagtaccggggaagggaaaagagcttttttttttgacaaattagtccttttaaaaaacttattttcaaactaaccctcgcaaaaagctttaactagaaataggcatgggctcagcgccgatgtcattagcgctgaggtccaaagggtcagcgccacatacgttggcgctgaacccgtggccacgtggaaccaaaaccgatctgcataccgacgtggcacgagttaaaaagctcacaagtctaaactagcattaatgatattgtagtgtggtggtgtggcctctttggttgcaagctagaggtagcaagttcaactccttcaattagcagaagttatcaatttttttgcaacttttttaccgtccttttctttaggacccctttttttccccaagtttactgtcatcaatttttttgcaacttttttaccgttattttcttctggaccttttgtttcccaagtttactgtccagctagcaaatcttcttgagcacttcccccagcggtacaaaccactttaaaaaagcaaatcgaattcttaaatttgatcccggtgttttttccccaagtggttacaaaaatattttgaaataatactgtaaaaaaagagaaaatattgtgagaaaaaagaacggaagtatactatatattccgaatgtaccgttggagtatatatgtcggaaatagtaacgtgggaaaaaataatggaaagtattacatttatttttgaagtatgcttattgatgagaaaacatgcaaaggctcccatcggatggcttaatcgccaaagcgaaacccaaaatttaaattttcaaacattttcatcatagtttcttttacaacgttggcttttaagtcaccaataacacatttataaatagtttcatctacatattcatttttatttcctaataagccgttttggcttattaggaaataagccaaacgatggggaccataatataagaatacttcaaaaataaatataatacttcaattatttttttcccacattactatttccgacatatatactcctacggtacattcgaaatatgtagtatacttccgttcttttttctcacagtattatctccttatttttcttacagtattatttccaaatgtttttttaaccacttggggaaaaaacaccaggatcaatttaagaatttgattagctttttaaactgatttgtaccgctggggaagtaccggaa

SEQ ID NO: 109175 - DNA, 735 bp, Oryza sativa
tatatatatatatatatacctaaaggggtagaattattttccaccccgggtttaaaataaccctcttcccgttggcacggttccacgcggtcccggggtcccgttcgcgcccatcccgcccgtcctcctgtgaaacagcgacaaaaagaaaaaaagatcgagaaaaaaaagatctcccatccctcccactccattgctgaaaagaggtgagccacacggctggcgccgacctcggctacggcgcgcctgcccgcggcgctctccctcccttcctctatccccctcccctctcggtccctccccctcctcaagatccatctatttctctcctctccctccatgcctgttttccctcccccttctcgttctttcctctctttttttctccgttgttttttttctctcttttctcctctccattgttttttctttttttctttcccaattgttttctctgcaccaatttttttttatcacgtacttttttttctccattttctttcctatctatttcaggtgctccaaaaattgaatactaaatttacaaaatccaaagttaaactcaagacgttatggtttaaagcaagttttctattcaattcatctctataacattttgtgagaaagggataagatgatcgattcttattaaacttaaatcacattatcggtcccctctaacgtttagtatgttgatcaaaccaaaatacatgggacatggtagattaaattcta

SEQ ID NO: 109176 - DNA, 990 bp, Oryza sativa
ctatgcttttcattgtttcccccagattctcactggttggtatatatgattatgaacagaaaccaggaagcctgaactaattatggaattggtattctgtatgagaatcgatgaatttgtgttatttgtactacagcataacaccgagttttaacggtgcttgtcagtgcctattagaaattgtaggctactagatataccatttgtgcactactgttgcgtttgtacttttcaaatagttacaatatagctttaattatttttagaaagctaaaaatcaacagtgatgttatatttttgggaaaacagcttatagggatcaatattttattaaccaccagttttcgaatataaaccatgctagttttgtaaacttttttacgacaagcctgcttttatttttgcatatttgagtatttattcgcaactattctgtctatcatatttggggtgctcacttcttattgccattgattgcttttaaatttataggcgaaacggcttattaacaacttgaaaaatattttatgaataaaaaacttctatgcaagtgtccatagaaatttaaatgttaaaataaacttcaacaaaaaaaaaacctagaataaactaagttttaaaattcaaattttcacttatagctaatgactaaatgaatgtgtaaatatctgatgaaaatagcatataatgacaaaatagaggagtcataattatatacgtttcaatgctgtttagttattccctattgttacttgtaaaaggaatataacctagcactccatcatatacactatgttgtatgaaaccttagaaaccctactttttttaatggtattattaattctcagtcactgaaatttctatacatatagtcacttgatattgaacagtatttggtgaaaagttatagtggaaatgagtatgcaaatttggatagatctctgttatcaaatggatgtcattttataatgggtgcagatacaccttgaa

SEQ ID NO: 109177 - DNA, 958 bp, Oryza sativa
taaagaagggataaaggcagacctaaattgaaaaggaaaagataatttcttatttgccatacgaagttagttggattcccccaaaaggtcactaattgaaaattttgctaaacatggtccctatacagcacccggagggttatgggaaaaaaacgagttccagtagagcccaagcatctttagcaatagtacccattttaaagtccccattagtgaattggaggtttcccccatttcttcacaaccagaaaatgtcttcaactttagcaacaacccttatttctttttcttacatttcaacttatactctatatttatgtctagtttaacaccccaataatataaatataaatatttcgaacacaacttaaaattaaattcaaaatttccaacattgcaaaattcataacaaaattcaatttccaaaaacacatgcatataagttcacaagcattatataataaaaaaaagcatatcgtacaagcatgaatggttcaacaatgggaataacaaatttaaaaacaatatatttactagcaaatgacatatagatcattgtggaacttaacaaatagaaaccccaaagaccaattatggaagcgacatatcctattaccaaacgacacatggatcatccaataagatcaaacatattccatcgaggagctcaaacttcttcattaccactaccaaattcacctccaaagacactactaccactaccaaattggccattgagggcagccacctttgaagcaacaatttgtgtcctcatggccaacacatatgttctcacatctgttccaaggtggagacatcacagaacatgattttctgttcttgctcccacactatcttatgcttagcgaatgagagcttgcgctcttgaatctccttaggttgtgttcggttttaggggatgggaactaatccctcccgcacggaaatggagcgatcc

SEQ ID NO: 109178 - DNA, 682 bp, Oryza sativa
ccaggaaaacacacccaacagtcttaatcttaaatattaaccagacgcagcaggcgaacaacatgatatagcctggcatcaaatagagccagatctaacacctcgtgtgcttctttgtgttggcgttgcagaatcattaagatctggcagtttgcctcgaaaaggtacgactaccactccatgaccctctctttgcaacgtgctgatctctcgttcatagctatcccaacaaggagacccagaagcaagctagagagcacaaataaaatatttgttccagtctcaggctctcagctctctcacgcatgggctagttattgggcatggccctgattggcatcaccatttgacttggcggtgactattttagtagcagtgtagtagtgtgtgaatgaatacagtgaagcagcgagatgtagtagcagagaacagcagctagcaacggtataaattaagagatacaatgcgtaatgtacgtgtgctaatgatgctacgacttggcctgtagaacataatggtggcaattggccagtgtttcagttattctcggagtcagtgtccatgggagtgtgggaagaagaaatggcaggaattggagcatgcgatgatgatggtggtggctggctggtggccgtggtgatggtgtcagtcagggcacaggcacttctcgtaccgatcaaac

SEQ ID NO: 109179 - DNA, 1681 bp, Oryza sativa
tgctatgagtgtcttatttgttgtttgtgatgtgatgttgattttattccttttaagtgctcattatgtcatatcatttgcatatcatatctattcttctgcttatttgcatcccacgaatgagtagggatgaaggaaactctcctcggttgctcccttatatatatgcatatgagtttcacttgtatcttccacatgcatatactaaaggggggtttcattcacctctaaccattcaaaacaaaatttatatcaatctcttgtaagctttaaccatattgtcatcaatcaccaaaaagggggagattgaaagttcattaattcccctagtgggttttggtgattaatgacaaatgtggttaagggactaatgagttcattgagtaactttcaggtgcattagtccaaggtgtggaagatggaagcttggagacccccccaaaagtataaaaccaaagcggaccggaactcgagaagtgcataggatagtttatgtattgcaatcgagtttttaggaaaaaccgtacaattaagaggggttccaggtgatgctctgagatatgtcaagtgctattagtgtgaaccaagtatcaagtttccctaggagtcatttttgcaaatactccatctgtccaaaagtgcaagtccagaacttcctgtcttccaggtccggaagttccggtcttgagaaaaagattttcctaagtgtagtccggaagttcctgtctttcaggtccagaacttactatctagtttccagttcaaaattgtgagtaacggctagatgacatcacctagccgttatacatatacagctcgtttccagctcgttctttagccattccactttcacatttcaaacctagagctgttgctagcctctcccaagtgttttttgccttctccactcaatctagagcctaatttttgtgagagagagattgagagggagagaagaagatttggagaggtgtgaagactaggatcttgggtgagcacttggaatatctcgtgggttgtcatctcggtgcttattactcttggagatgatctcctagacggttaggtgtggaccgcgagtatccgttgtatattgtggatgtcccaggtaagtttgtgaaggatcccctctcctccgaaagggaacgaggtaagttagtgaagttcttatgctgagattctagaggctttccaagtagagcaacccacacttgtggcggatttctagaagtaggttgagttggatcttggtggtcactcaattttagaaatttgcctaggggtgtttggggttgaaggctgtggatttcctctggggtttttgcacaagtgaggcaaggggttaattgagacccagctctttagagctcctcaacggagagtaggatcgcaagatccgaacttcgggaaaaaatcgctcttgtctctttctgtgatgtttctgtggatgattctgtgatctatctcctacttagaatacctgtgcatcatcttgataagattggcttagtctcctgtttcgaaatttgaatttcatcttcaatctgtaacccggaagttcctgtcctaagaacaccgaaagttccgggcctggcaggccggaagttccggagttccttaccaggaagttccgggtctgtttgaattttaccgctgcgatttgtttttaagtttttaggga

SEQ ID NO: 109180 - DNA, 1873 bp, Oryza sativa
gcatcatcagaggcaagaaatcaagaagcgggctctcgaatcgccgcgcatgggtaagataaaaccctaaccctattttcggaaggcaaaagcccgcgcatgcgcccagccgttgggacctacagcgaggaggaggaggaggaggacatgggcccgtacctggagcaggagcggcgggagcgtccggctcgtccatcaccttctccgcctgcagcgcctccgccgtggaggtggtggtggcttcgcgccgccgtttcgaggaaggctagggcgccgccacccaccggctccgcctccccttctcctccgcggaggctaccaatggagtcagggagagcagggcagcgcgcgatggcggtggcggcggcggcgaggcgacggcggtgggtttcgtcggatttggtaacgggcgcggcaaggtcaaagccgggtttcgttggcctcctcttattgggcctgacctgtttgttgggctttgtgggcctccatttgctattgggcttctgttatttagagttggcctttcctttcatctcccacgagacgtaactgctgctcaaagctgagtgttaatttggtattcttcccgaaaatgggttcaaactaattttattacaaattttgtcagattatgcaatttttattatattgataactggatgagacggcagcatatacatatcacgacatgattgttacttcctccgttttacaatgtaagttattctagcattttccacattcatattgatgttaatgaatctagacatatatatccatctagattcattaacatcactataaatgtggaaaatactataatgacttacattgtgaaacgggagaagtagatacttagaaaataagcgcactcgttggcgtgccattttcatagcccgtgtataatattaatgttgaaatttttccgaaccataccagactcaatgtccctttaatgtcataaaatttgattattaaaaatatagttcgtcaaaattagcaacttaaagtcaaaaatgtattttatgaaggcaaggagtatttttaatggtatattatatttacatgtgttttatgatagtataaaatatcaatttctcgatacctactttttttaagaaaataattttaatccgtttgtttgtgttctcgaataattatcacaaaatcggtttcatttatcatccattagctagacgtgtgttcatagttttcttcttttttccacaacataaataaattcggtctcttcttgggacatataatgcgtgcacttaactattacaagcacatcatatagttattttcatgccctttctcaaaaaaattcatacccccaacattgaaaaaaattgctattatcatatatatataaattttttattcgatgttctttaacaattgtacatataagccaatttttcaatgagtagctcacataagctactccctttgtcttaaaatataagtatttttggactctgacacagtctacgagatactattttgactaacaatatctataaaagtgatgttttaaataaaaagagttacatattatgatagtttgtttaatgataaatctagtaacatcaattttatatgatatgatcttttttatatttttactattaatagtcaaagttgaaaatgtttaacttgttaccatgctaaaaaaagtttatattttggtacggagaaagtagcttaatagctatgataccttggaatatatggtaataccttgaaaccatttattcaagttacaacttgggatttcaggtacacagacttataacggttctaatgatcaggtggattaattcccttgaagctgcggccacggaagtctcttgatgtttcgttttttttc

SEQ ID NO: 109181 - DNA, 581 bp, Oryza sativa
cgacctccaaagccatttaccctctcattatactgttgcatgagctctctctctacgtgcatggccgatggccatgagcttttaacacgtgaaaccgttaatattttgatacacgtttgagtattcatcttaattattaaagaagtttatagaattatttattttttattatgaatttgtttatcattaaatgtacttttaccattatttacattcgtatatttacacgtgatttttttaaaagaacaaacgatcaatcgcgtgtcaaatagttaacgacgtgatctatgaaaatccgaaggtgattttagtccctccggaagtatattggatgctttatacatcgacatatcgtgtatcactgaaattaaccgtaattatgaacacttgttaaatttaggatgtatataaacccgagttgacatgttttaccacaagaaaacctaacctgccgagctccacacaattcgcggagggggcataatatattaatgtaatgctacacttaattgcaattttaaccactgtcatgcttaattaatcacccgtagaagaagaacacgactaggggctgcaggaat

SEQ ID NO: 109182 - DNA, 549 bp, Oryza sativa
ctgcaaacgggtcctcaatcacatcctccccactgtcctcaacctcagaaccatcgggggaacacggcaaatgggcgttgcgaaggaggttcttgatccgtcgagtgtccttcttccttgctctgcgttccttggcttgccaagctaagatggtcttgcataagttgaagatggacttgaagaacctcaaggacgagttggaatccggcttggtgacggtagcggagggaccggcacgagaagaagcacgagtggtttgtccagccggcacagcagcagccttgatgggacggacatggtaaccggtatgtgccacctccttgtgaaacttcttcttggacataatctcaatcatcttcataatgtaaggcccatagccaagtcctcgcttagggcttaggcatcatggagataagccggatttcttcaaagatgaagtcaaaggcgtcaaagagctgtgggtgagccttcatcttgtaaagcaaatttcttgtataggcaaggacgttgctagcatcaccttccttgggattgagagttttgcgcaag

SEQ ID NO: 109183 - DNA, 739 bp, Oryza sativa
ctgcagcccttttgtttggtatattatacttgttttaatatctttatatagagtagtttcggagtattagccgatacatgctagatctatctgatcggctatgctataaacatatataatcctgttattaatatatatttcgatctaagtgatttatactgtctcggcatggtgaccgatctatcctaatcacttgatttaagtatatattaatataagaactatatatcgttaatatctacagccgatcgaatagatttagttccttactatctatttataaccgccgatcgattcataaatgacatcggctcaaagataaatgatatgtcatcggcacctagccgatcggctatcatttatagatttaaccaagaattctttgtctctatttcttgttgattacatgatcaaatcaactggcacgctcacacattcgaaggcaagctttggacctgcactggagttaagcagatctcccaggcctcgtgttttctgtcaacaaatgtaagtatactatatatattagaagtataggaatatattttctttctgtttttttcccagttagcttagataatatattatgagaatgagtagctaatgcttgtgtgtcactctacccttggattatcttaacccctgcttagaatatgattatcacaagtaatatataaattattagtcaagttctctctacatgatctttccatgggataaaataaatacgatgcccttg

SEQ ID NO: 109184 - DNA, 695 bp, Oryza sativa
ctgcagcccctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttaatacctgataataatttgcctagctcctggtttggagttagatctgtacagccgggtatggttgttcaggatggttgggcctgtacagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtca

SEQ ID NO: 109185 - DNA, 903 bp, Oryza sativa
tttaattaatctcgtcatatgatctaggtgatcgcttcgttcagtagtttgaacatttttattacaaattttagtcatttataaattgtattcctagttgagatcttaattttatttttctaatttcggaatttgatttatttttatgtcgaattttaattgatctcgtattgtgttctatatggattattattttaatattttttattttagttgttcaaaattgtattccttcctgaactctcttttttatttttctaattttgtatttttattttattttttattctgaattttaagtaatctcgtattgggttcttatgtcgacttgtctttcaatattgcctatttttaatttcgaatttcagttaattttaaattgtattcctatttcaactcttattttattttcttcttatttctaattttatttcattttttactttaaattttaattaatcccgtattgggttttcatatggactcttcttttaatatctaatattgcttacttttataatttttattcctacttgaattattatttattattttcttctaatttatgattttattttattttttgattccgtttttttaatatcgcttatttttaatttcgaattttagttatttttaaattgtatttctacttggactattttttttctttgtttaatgtgcgaatattgggagagagaaaaggcatgcattgagttcagttgtgttacgttgcctggtctctgatcgatccatgcagatggagttttttttttactgtagtgtcattatcctattcatattctattctatctcttccttcctaaatttgttagtattttatttctacttctataaatatagctaatatagcttgtatttcgtatccaacaataccaatca

SEQ ID NO: 109186 - DNA, 925 bp, Oryza sativa
atcgataacatcgggggacccaaagaatctctccatagaaggggcgaatctcatcttagttattcaatatcccactacatgtttcatagcatacccgaagactacttttataactacccagttacggagtaacgtttagcagtccctaagcaagctactacacatgttgggaaccatgataatctcaggtctaaggattatataccaacactaaatgagaccactgatggcacaacacatatacctcttgcagtgtctcatattgagtctatccaacacatgttccccaacatgtctctacattattaatttggtatctccatatcatgatccatgagacatgatcatcaatcaatatatgtgctgatcatttaaacatatttattccacatatgatatttgatcagggatccattagaaatagcaacatacaacataaagagtctcatgaaagaatcacatatattaatcaataatgagttatctatttcaaggaataatgtcggataaatatgtaaacatagtatatgatacaatcatctctatgattgcctctagggcatatcaccaaacctcaagtgacctttgctagcttctctagaaataatattttggatgggggttctggagtctggactgtgagatcagcttctccatggtggttagcaggagagagcagcctctgcagtgatgctagtttgcagccgagctaggtcagcaaaattgggtgagaatggcaagtgaaaatgatctgaatgaaaggatggcatgaatgagaaatgctcaaaatcaacggcatacatgaaaaattaaactttatttactggtgtaaattatttttttcttattttgtgtcactcctcaacttaattcatttttcagaagatttttatttccccctcataacaggttttagcaagacact

SEQ ID NO: 109187 - DNA, 665 bp, Oryza sativa
atccaaattttccttttgtgagtaatcctgtaaatgcactgcacagaaggaattttaggttttgtacttattcctacaaatggtatgtgctgaaagaagaatttactgatggttagtacttgataccttttgatacttcttgacaatttctatccagagactctgcatgctttcttttatgacctccagaaacctgcaaggatcactgagggtttcagccctcctgaaacttcattttcaacaattaggaagcattgaagcacactgtaaccatctcatgcttgcatcaatattaatttgacatagacaaatgtatccgttgaagctctatttggccaaacagaaaataatgctagtatttttgtcaccagaggatgtaaaggatgtttgcatgtaagtatccttaattaaccttaactctttcatacagccctaaattcacttggatagacttgcatttgataaactaacagggttcagatagcttgctttagggaaagttaccagtgttgaatttgtcagaaagtatgtctcaatttgtccgagttatctgcatcagaatgttctgcaacatgtgtttgcccacgtcataatggaaaatggactccaaaaccaggatgccccgaccaagtgaaaaaaagatgttcaacacgtgtgcatttact

SEQ ID NO: 109188 - DNA, 743 bp, Oryza sativa
aagagagcaataatttagtcaacctttttaataacgaagataggagtattttattagtaagcatgagtttaaaggaagagagcagtaatttagtcaacttttttttataaaaataagtggtgccaaagtggctttacttggatggaatttgaagcaaaagggcaccaatatgaaaaagtgccgtaacagttggatggcaaaattgttaggcagcaaaaattagcggcaaaagtgaaaagtttgcacttcccttaatagagaaagctaaaatttttctttgctttggtacacctttttcccgaaatatatagattcttaagtcctaagttaaattgtccttataagttttggccaaatttattgaaatatatatatatatacaatatctaattagatccattatgaaatatatattttcatagtttacttctttgatgggttataggtatcaacattgttctccacaaagcttggtcagatagacttaggataaacccttaaattttaagatggagggaaaaagacaagccagaaaaaaactactccgtcctaaacaattgcatttcccataattcaaatttcagtacatttgtaatattgcaggttattttttatttgttttggacattgccgcaatttttaatgcatatgtttctagttatatacttgtaagatatattgaaagtataactatatgaatgtgtttttcatgaaaaatctatcgataatattttctaatgtca

SEQ ID NO: 109189 - DNA, 502 bp, Oryza sativa
aactagtctaagatcctcagagttgttagttcttgcactgctcatagccttatcccaggtaggcagagttgctgtagaattgagtagtaactgctcctgcaacatttaaagatttgccagggtcagatttcataattgcttagtgaaaattaaaggctaacatcattgaagattagaaacacaaacttaaacacatttaacaattaaaattaatttctatcagtttaatgatcatataatgatacagtatttccctgcctgtgtagataaaacaagcaaatatttacctttttgttaatacttccttcagtcatagaagtttaggacaagatttggtcaaacttttgaaattccagccattaatttcttataaaattgcttagttttgaaaacagaaaattatatgcatagatttgccttaaaaagtactgttataatatcatatacttaatatattttataaacttactgtaatacaaaattgatggccggaatttcaaaa

SEQ ID NO: 109190 - DNA, 1600 bp, Oryza sativa
ggtagtaatagaaggctataagccagctataaacatattttaagaagataaataaggagagagaagatgagcgggctatagatttgtagccaactgtagtacaaattctaatgcacaatgtgtctatgatagatgggaccagatattaatagtatagtatgtaactattgtatgaattagctattagattgattgtagatgaattaagctagtagttgtttatactattaaacttgctcttagaggttatacgagtacagacaggacttgggttcatcattgcatcaagaatcttgacacgcttatcaatattgcagtctgcaccactttctgctcctatcgagcaacaggcaacaggccaacagaccagacgagcacctatcacctcatgcaacactgatttttggtacagtaaaacacttgattttcgttaatcccactggtgctactccgtagtactacatagccctgtttagatgggactaaaattaaaaattaaatccgtattacatcgaatatttggatactaattataaatattaaatatagattattaataaaacctatccataatcttggactaattcgcgagacgaatctattgagcctaatataaactttgagaaataaacaaagcaacctttctacttaaactctacgtagtaaaaaatatactactcgtatgacaaagaaaatcattctaaaattaagtttcaaaatttacatatggttaatgagcttaaaagtagataaggagtattcctctaacaacagggtctattgactttgcttaagagacggaggataaattaggctgcgttcgtttgtgagacatagggtgagaaagcatctcgttttcctcgcgcacgtttcccaaactattaaaccgtgcgtttttataaaaaaattttataggaaagttactttaaaaaatcatattaatccatttttgaaatttaaaatagttaatactcaattaattatacgctaatggctcacctcgttttgcgtatctttccaatctccccaatttccttctcctcaaaggctcaaacacacccttagtacagtgaaataatactcaagtagaatacttggtactactaatatataggcctggtttagttcccaactttttctttaaacattcaacttttctatcccatcaacattttcctacacatactccctcagtccaaaaaaaagacaaaccctgttttccgtgcccaatgtttgactatgcgtcttatttgaaaaaattatgaaaaaaataaaaagacaagtcacgcataaaatattaatcatgttttatcatctaacaacaatgaaaatacgaattataaaaaactttcatataaaacggacagtcaaagttagacatggaaacccagggtttgcctttctttttgagacggcgagagtataaacttccaacttttatgttatgtcatatcgttctaatttcaatcaaacttttaattttgacgtgaactaaacacacccatagagctagctggccacttgtacggagaatgcactggtttgtcctctggacagtccggaaggaatatgagtggaacggtcgaatcggcgttgtggg

SEQ ID NO: 109191 - DNA, 681 bp, Oryza sativa
gtatataagtttcacgtaattttgaatcgttaatctattacaagatttgttttggtgaggaagaaaaaaaatcgcggcacacacatatgtgtaaggatttgttcccacaacctccattttacggaaataacatattacagagatatttttgaaagttacatacaagttacactatagttagagtgtaattacatgcaagttacagtgtaattacactacgattgtactataattatatctgtcaaatttttggaagaaaatttgtcgacaaaaatatagcaaaatcgcgtttttttaattgaaatctatttcagaatcactttttcgattgataccaacaatcgacgacgaaggcctagcccggcccacagtccggcccgtcatttaagaggatcgcagttcttgagggagggagacaatcccaaaatcgagcaaaccctagccgtcgactcactccccttcctctgcgaccttgttgctgctgtctgctatggcgtaatggcgatgcgctatctggccggcaagttgaggagtactagtagaatgtgttcttttatgatggtataagcatcaaactgcacattaattactagtagtagaatgcatatctcacaaacaattccacagtaggaatttactgaaattccacagtaagtatttactgagaaagaactggagcag

SEQ ID NO: 109192 - DNA, 736 bp, Oryza sativa
ttcctgcagcccatcgataccgatcactcaattaaaggagtgaggtatatatcttatctacggctatccctatgttagtgaaagagtagtatgtttgaggaaagactaaatttaagagaactccaaaatattttatgaccggagttgtagtgattttatatttgtgtgtctactgtacacatccaatgacttttctctatccctatgtgcgcgcgcttaatcttcagtaaggtggataactcgtttttatcgaatgcaatatatattcgcgaaaaaagggccagctatcccttcctttcatattataaataattttaaattttacttgtcactttttttaagttgaccaagtttttataaaaatataaaaaaatattttcaacataaaataaacatattatgaaattatataaaatgttatagttttaattaaactaattttgtgttatagatgttactaaaattttctattaatttaatgtttatctaggaaaaaggtcaaaacaaataatgtaaaacggatgtagtataataattctaaaaggccattcaattgcaatattgtcgtatcgtgtaatgttgaaaaaaaaacaattttgaaaatgtacgggaatgtcagtatcacaaagactcaaagaggtaattaaacacgaggaaatagttaagattaatttggcatacatagctaattgttccaataaatcatcacatcaactatactgatagatgaaaaatc

SEQ ID NO: 109193 - DNA, 1903 bp, Oryza sativa
aaagatcgtcttttaattttaaaacctacagtagttattagaaatttcacaagctagcatgttccagtgtgtatgctaacagaaaaaaaaacgaaactttagctgataaagcaatggcttaacaacatagagaaaaggtttattggtaaacttttcatataggaatacgtatcttagaaatctaaaaaccaatattagaaaatactataattcaaaaaatccaaagaaacatttgaaaattactccaacataggagtaagcggctcgaaaaaaaaatacagtggggataggagcatccgagcagggagttcttatcgagtttgacatgcttgcgtctgcgctgctcagctcttaattgcttcgtcagggcctcaggggtgcaagactgcgagctagtagtaccagagtagacctacatcacatgtcactcaccttattaactgttcatatgcaatggccgtgtttagtttcaaattttttcttcaaactttcaacttttccatcacattaaaactttcctatacacgtaaacttctaacttttccaccacattgttctaatttcaaccaaattttcaattttaacgtgaactaaacacacccgaattatttctgtttatacaactatgcaaatttctaatagaagaactcataaatcaacaacggtttagaccacataacttcatatttaggatgtgtattataaaactataaatttagcactaaatatatcacgatactatagatcttgtgtcatttgtagttttataatatgtcgtattaaatatgtagtttttcaattgtttattcaaagtatatgcaattttgtggattttactctttcttggagttcataaagtcaaaggacgaaacaacacaccaaagtagatcaattatttgaattaagttttcaaaatttctaaaacctcaaaccggccagctggggcacgctagctatcacgttttaattttgacctaccgatagtacaatactgctcattcgtgttccataattcttggtatttttaatataaagttgcgatcgaacaattaaaattttaactataatagtaattaaactatttagtttaaaggcactcaaacatgatgcatagattagttttaaaaatattttagtaaaattaaatatttagttaatttttgtgtaaattttataaaactccacctattacagccaaaattacaaaaaactatagggattttgataggtggcacataatttcaaatattattatcttaaagttttacaaaaccaaaatatttatcattttaacttcggtctacacacttaatatttataatgttttacaaatagtacaataaaaacaaataatcaaagacatattttattggtcatgacgttgtctaaaacgtcagaaaattagctaggggtactagagtagtagccaaacaagaaacaattaaggaagagtttatatcgtgtgtaatatggttaaatgttgggcacgaaaatcagagtttgtcttttttaggacgaagggagtactccctccgtcccaaaaaaagacaaaccctgggtttgcatgtccaactttgactgtccgtcttatatgaaatttttttataattcatatttttattgttgttagatgataaaacatgattaatactttgtgcatgacttgtctttttatttttttttataatttttttaaataaaacggacggtcaaacgttgggcacggaaaccagggtttgtctttttttttttttggacggagggagtactccgtatagctagggcatatacttaaaaactgagtttggggggggagtggtgtgattaataaatctgcctcattccgacatttaaacagaagcatgcattcatgcttaattagcagaaagcatgtactggtgcg

SEQ ID NO: 109194 - DNA, 2116 bp, Oryza sativa
gatcaaatgttggatacgaaaatccataactataattaaaatggaacgaaaggagtactaattaaggttggctatgtaccaatttcagatgctttctagattggaggggctatatacatgcatgatgagaatagggcttgttagttgttatatctatcttgaacaattgataaaaagtgtttggagattcgtgacatggccctctttacaagaaaagtggcactagtacaatgcaatgcatataaacctttcaccctctctttagttcatgtgagatgataaacaaatggaaaggggagcctaaccacacctgaaacaatatcttaatatacaagtatctagctaggctataccggctaatagctagccctatatgatcgctttctcaacaagtgtcaagtagtagtgtgttatactaacggtgctgagtttttaaaataacaattgaccattcgttttgattataaataatatactaaattataagtcatattcaaagtttcattataaaacatatcacacaaaataaattatatttctacaattttttagtaggatggatagttaaatgttatatgttaacggtgtcctctctattaaaaaatacaatggcctatagtttgtatcacaatatgccttgttcagaattcagatttactagtgacactgtaacggacaatactaattagattaatccaagtattacagctcgtaattttccatacaactggtcttatattactagggaatataataaattggacatgaagagtctattctattttttaccttattacgcagacttgtgatagtcatccacatgttcatgacagaattttggagtaatgcattatatattctccttgtaaattttacagcaaaaagatgataacataaatgcaaaattgaaaacatgccattgtttgttaaattaaacatgccattaacccccaccatctaccacggttctctgcagcggacatggcatcctagtgttcatccctttttactccctccatcctaaaaaatacaacctcttactataacaaatctagatataagtacgtctagattcgttgtattagaatgtgtcacatcctctgtcaacgcctcaacattcaaatagaaaaaaaaagtttaacaattgaatctgattttttctgatttaaattttgctggaaataaaaatcaatgttatccctttcttgcaacaattataaggagaaacatgtggagcaacaaatggctagacaaatttgtgtgataatctgtaaatactataattatatattttttaatatatacactatagaatcctttcctacagtcctttctttaaagaaaaacatgtggagcctaaatttatctgctttcaaacatgaaactactcatcaaagtgatactacatcagatgcctctggtattatgtttcagtcattcctttcacctcttttaacctcctctgaacaaactcttcttacacatgctaatgataatgaatactggcacaattaatatttccaatgatactgaaatagggaaggctgtctcacacactgatctcacatcacctcactggttgcagtacctagcagggatgcggaaaatggtgtgggtacccacacatgtcaccaaagcaaagccatatgagatactccttccgtccaaaaagaatcaacttatgcccggtttagttcccaaaaactttttcccaaaaacatcacatcgaatctttgtacatatgcatggagtattaaatatagataaattaaaaaactaattgcacagttagaggggaaatcgtgagacgaatcttttgagtctaattagtccatgattagccataagtgctacagtaacctacatttgctaatgacggattaattaggcacaaaagattcgtctcgcggtttccatgcgagttatgaaattagttttttcattcgtgtctgaaaaccccttccgacatccggtcaaacgtctgatgtgacacccaaaaattttcttttcacgaactaaacgggcccttaggatagaatatgatttatcctaagacaacaaatctggacaaaacacttgtctagatttattgtcctagaataggtcacatcttatt

SEQ ID NO: 109195 - DNA, 854 bp, Oryza sativa
tttcatataatgagatcaatacctccaaaacagtttttttggtaccaaattaataattagacaaagatcataacctttcattattatacactactaccaaatgcgtaaactaacaaacttcattggtcccatcaggttgaagctaggtaggttaaaaaaagatacaaatagaatgagcacgaagttgacttcatgtataatcaacttttatttaatcctatcaattgacttcaacataagttgatctcgtaaccggcattgtacaaaagaaaaaaaaagagcacaaattttaaatgaccacattaattgactgtccctgttactcaccttatatatctgtggcatgcatcttacttaatttcttctcttagtagctagaaaactgaatacaagatctgtcaaaaatgatgccacataaaactatcgcattcgacaaaaatttagagataaagttttacatattttagaccgttggatccacaccaagattcgtgtatgggcttcttctcctcctactccagcaaactccccctcttttccggagctggcgaggccccaactccagcaggtataacatacggagcaagaggcacgagagtgagtggtggcatcgagagctcgcaccgtggtggtggggagggaggaggatggaaaagagagaggggttaaggttagggaggcagcactaatcttaaagcattcaaatggtctaaaatttgcaagatttaaagggtttattttatcaacagtcaaatagacaatccctaagactataccctatattctttattagatgtcgatttaggatgtgtgtgcaattagctttgtaaacattgcaccatgtgtactcaaat

SEQ ID NO: 109196 - DNA, 1132 bp, Oryza sativa
cgtgatccatgtacagtagtagtatagcaagctagccaggtacgtatacgtacgattttgctctagttaacttgtacacatggtcaatccagtacggcagtacccacgtacaacaaccggtagtacatgtatacactgtcaacataatatacagtaagctggtgatttttttgattgacaaacaaaatacccatactttgctatcagctagctatgggtaaaagaaattatattgtaatattttttatcaaatattttatccgtcctaaagtataagggattttgatcggatgtgatatatcatagtactacaaatctgaacatttccttttcaaatttgtagtattaggatgtgtcgcatccaatcaatttttttttatattttggagcggagggatatgttaatagcacttgtttggttctttaagtatatgatattcacttcctcaaattgaatattagactatttcataatatctggatatataagttgtaaaaacaacaaaagcaatagtgggatgggaggttcactcccatcatcattatagccttttattaaaggtgtatagattttttacatgtgctttgttttttaaggcattctccccctgttgacataagaagtcttaagcttgctagctgttagccatgatcatatccaggcacatttgaaatgtatgaatttttacataccaacataaaaatgttttaaaaagtggcaaaataaagtagactaatactactccctccgccccataatataagggattttgagtttttgcttgcaccgtttgaccactcgtcttattcagaaaattttggaattattatttacttttttgtgacttactttattatcaaagtactttaagcgtaactttttattttttatatttgcatgttttttttaataagacgagtggtcaaatagaataagcaaaaaaattaaaatcccttatattatgggacggagggagtagtacactaacaacagtttgagaacagtatgcatgttcccttcattgtctagctagactacctgatctttgcatgcatgcgtacgtatcaattgattactgatcaaagggaagctagctaggtactagtactagtcggaagcatgcccaaatca

SEQ ID NO: 109197 - DNA, 743 bp, Oryza sativa
ccgcgagagctaacttggtcgatcgctcccagcgtagccgaatgcccctctaacatagaaggattcgattccgaccaatatatacgagtctaattatactaacataacatacttgtagtaaaaaaaaattcggatcgaccgaaccagctattgaagcggaaaagaacaaaaccagtaacccttatggctcgatttactatgaagactgtccttacaaactagtcagagtgaaccggtgatgaggacatcctccactattacccgctggcaaagacgccaaagttgggcggcgaccgtgtgagcctttgaataatcccaccttgcttagcttgggaggaggaagccaccttaaaagggagagccatcctttccctattggactaatcttttagggagattgggcatttccctgagtgggtccaggcaaccttaagttattgggcctcggccaaccccacctgggctggattgttatcaaccgggcgtttaactgtataaatcgtcaaactaagacataccgaaccggccagtttgttgcacgatgggccttcacccatcaaaaagaggggttgttagagcatagatgcagccgaaccggccagtttgttgctcgatgtgccttcacccatcaaaaagaggggttgttagagcatagatgcagccaagatagtatactttatggaggctgacatcatcccacatattttcttcctcatcacaagtctagcgtcatcccaccccta

SEQ ID NO: 109198 - DNA, 756 bp, Oryza sativa
tatctattggctggtccagtccctcgattgattaattaatactccctctgtactcattgtactcataaagaaagtcgtttaggataatgtttaagtcaaaccttaggaatataaatcacgaataactctcaagttattgattttgaaaatgtaaaaattatatgaatagatttgtcttgaaaaatactttcataaaagtatacatatatcacttttcaataaatatttttatagaaacaagaagtcaaagttgtgttttggagaccatgtcgctgtcctaaacgacttcctttaggagtacggagggagtatactccatccgtcccaaaataagagagattttagatagatgtgacacatgtatcctagtactactgcctgttcagattcgtagtactccctccatccacaaaagttacgcatattacttttgtcacaaagaccaatgagaaattaaatcttcttggatgttacaaaatcaaggagtgaatgcaagcatgcaaccaatgagtatttggatgactccttgggttctcataaaacatttaatttatctcttcatttaagtcttaaatacataaagactacaaataggaacaacttatttgaaaaactcaaatgtgaaatatgtctaacttttgtggatggagggagtactaagaatgtcacatccaactaaaatatcttatattttgagacggagagagtatgttgctagttgagacgctgtctctctgggttaattgcatggcgtag

SEQ ID NO: 109199 - DNA, 602 bp, Oryza sativa
tgtttccactatgggttgctctaatgtagcacaagtagtggacatagttggcacatcataattatgcataccttgagtagttgtagcaccattatcattacctttttttcttatcttcagaaattataggcacttagtcaattaaacattcctcaagtatgcatgaaactatggataggtctttttgctctccatctttcttctcttcctcctcatcatcttcaacattggaggtgctgatgtagccatcttccgtagcaacgtatgcccgttgactagggcaaaccttctgcatatggccaaatccttggcaatggtggcactgaatgcgtcccgttgaagcgacggatgaggcactcttggcgggtacctgcaaagaacttgtacctaaatctgcaggtcgtggaggaggtggttttggcgctgtagaaactccagacgcaactggttgcttgcacgctggtgggggcgcccagaaagagataggcttgggcagactcgaagatggcgtcgtgcgcggtgtgtacgtgttcgtcttgttcttgacctgttgatcatgcccctgtaattccttctctgcaagcatagcaaactgaaacaac

SEQ ID NO: 109200 - DNA, 683 bp, Oryza sativa
cgtttacagatgaaaaaaagctagtcacagatgagtactccagaaaacggcaccctgacgagacagcagcaaagggggactctggatgcgggcaaatacaggcgttcacatatgaaaagataggaagggtgtgtttagttcaggttaaaattagaagtttggttaaaactaaaacgatgcgatagaaaatttgaaaatttgtatataggaaagttttgatgtaatgaaaaagttagaaattttttaaaaaaatttagaactaaactcggccgaagatttgtctccaaatatatatacagtatatatttacaggagtatctataactgtaaaggtcaatgttaacatcagtggagcatgacaatctaccctatcccctgtcagataggttgagattaacatcatctgtgtttgtactggttaagagatcgatagtatccatctgcagttactgtctagtgtgctgtgcacagtttatatggattaactactgcccattctcttctgacctctctttgttttagagggggtggacaaaaaatattatatggattaattaatttctcattcaatgagaatggttgaagataaggtggttaagacaagattggatgaaaattaaaatgaaaggtggttattggtggatataatactttataaatagatataatatcttgggacaaag

SEQ ID NO: 109201 - DNA, 869 bp, Oryza sativa
caaatagttgaaaataagtaggtctaaacaatgcaataattattttaagcaaacatatattttaaaggtcggagcatctgctttaataattatgtaaatcatctgaaaagaacgaagcctagcccataaacgtcaagaaatcatgagaaaaaaaagaagcactatatacttattctactatctcactgaagtttaaattctattaccttctttacgcatacatgggacgtttcgtgctgtggttagagatttaaaccattatcttcacttcaatgtgtggcattccatgttatcacaaaatatcggtgcgggttttccctattttacgtccttttaatggaatacaaagcccaatcatttcatattttcgcttatgtttatgcttataagctaatattaaaatataattttgtactaggagttgattttatggttttctgatcatcgtagtttccaacatttgcttttcaatcgttaaagacacatatatataactcataaattactttctagttgataacaagcggttcggatatgcatagtagtttgtaaatgctactataatttgaggatgttgtatatccataatgatacttatacacatttatatcgagacactgcaatattggccgaaaaaaaataagaaaatgtaatggcttagggaaagcacaattgatgtgatagtgtagttgtgctagtgcagttatgagtacctgactctactcgctaggttcaaatacttgctccgtaaacataattatatgtattaattggtgcaaagtctaaaaaatatacttccactaccataggacagggtatcccaatcgatccatctgtgagtgatgaagacttgaggcccgttacaaagg

SEQ ID NO: 109202 - DNA, 622 bp, Oryza sativa
tctttacatattctacttatatgatctatccactataaccagtcagatagtccagccgtgtgggtatacggtacccattatctccacatgcatcaaccttattttatataaatttattttcttgttgcttgatctgaattatgcatcaaccctatttatagaaagaatagtccctcgcaatatgatttaaagtaaaaacagaaaccaagagaaaacttatctctagaccaatttatttatttagccacttttgatattattcgtaatgggcaagggcactagaccaagttatttattatccagtttggatcttatatgtaatgggtaagggctttaaaaaactatacatctatgttgctaccctgcagacatattttcagtccattaatagccaatggaacaccatgggaaacagcagttacagctgttaatatgcgatggcagggaccagcattagtagcaacaatatttacctatcaacttatatatcagactgaatgctagttcacctctattcatgaatacataagtgtggaatttagaatttagcaaatgcctatcaagtttctttctgtcccaagcaaggttttccctgttgtacaccttctcccctatgctggtg

SEQ ID NO: 109203 - DNA, 584 bp, Oryza sativa
  unsure (1)..(584): unsure at all n locations
tgataatactagaagatccatgcagttttttgagtacatactcgatattctctgctatatatcctgccctctagaaaatatttttcaggaacaattgagcactcgagtaagttgtggtcgagtacaccacattatcgagaacgatctcaacaaatgcagagtcgtcgcgcccaacctaccaacgaagaccgacnnnnnnnnnnnnnnnnnnnnnnnnnnctggactactcgagaaaaggttgttaacggataattcctagcgaacgtcgtcggcttgatcacctgacatgattgtgaacggacatccggatatgctacaagttgggtgcgtgagtcatgctggccacatgagacgcacataataaaccaactctagcacttccattggtgttcgagagatcattctacacgttcgctggtcctcgaaccaatacatagcaatctctcgcaccgcaagcttccatcggtgtccgagagataattctacacgtttgctggtcctcgaaccagtacgtagcaatctctcgcaccacaacctccattggtgtccgagagataactctactcgctcgctggttctccaa

SEQ ID NO: 109204 - DNA, 516 bp, Oryza sativa
cctcaagattgggtacgtttctttttgcaaagacgagcaaatgctactacctccgtcctaaaatataataagttttaggagtggatacgattattaagaaagtaggtaaaattaaatggagagagtttgtgattggttgaaaagtgcagataggtggaaaaattgaatgatagagaattgtgatttgttgggaagagaaaacaagacattgatgaaaagtagcatagactttgggagatattgccttcagcaccccttgacccttctcttcctccctctcatctgctttctctctttaaattccgtttgtgcataactgagatattggtcaatcttcaatcctaatacataggtatatgcgctttgctggtcatatcctcaatcctaatacaaagatactcactttacgtataaaaaaatcatcttctcttaagttgccaaacaagctgttaacggttgatactaagttttaaaaaaaatactaaatgaaacacaacggtaagaaaattgttagca

SEQ ID NO: 109205 - DNA, 655 bp, Oryza sativa
ggcggtttttatagaaccgtggatcccccagccctggtagctggaccagcatgagcaggagcacgacagccatggcggcgcccttgaacaccaccgcggacgagtaggcgatcaccgtgctcagccctgtgatgaacagcttcgccatggccattgccatcgatcgcctcttgtctctgttgttcttttgcctgaacacgacgtgttcttgagattttttgatgaaaatttgttgaacacataatgtatgttcttgagattgagcagggagaagagatcaaagaggaagagatatgaatttgtttggtcgattggttgtgccatcgatttggttgccactttgagtggtagagcacgcattagactggtcgtttgcgacgtttgtttatgacaatgtactacctcgtgcagaatggttcagagttcagtgttctagtgttcctctcaagctgtctttgcagtttgtatcatcattgaatgtttattatgtgttcaagtcaactccccatctctctgcgctggcgggagaggagggagcgactcacgcgcgctcgccggtagaccagggagctcgcctagccatccgccgcccttctagctcgctggcgggagaggagggagctcggcatggctctagcgcggcgtaggcggcggg

SEQ ID NO: 109206 - DNA, 2143 bp, Oryza sativa
cgatcgatcgattggcactacgtgctgttagtactagcctagctagctcgatagctgcaggggcagcgtcacatatgcacgagatgagagacgcgcaagcgtacactccgtgcactgcccagtttccttcttttgatgcaccagggggtccagggccggatcgagctgcacacgcaccaattaacacgtacaggatgccacagcttttgtaccaaattacaatgtagtagcaaggctcaccagccgcggaatgggttaagctcccgtgcggtccccgacctgggcgcgtcgtcggctagagtagcgctgggtacgcgattgcatgggagtactcaactggtcgggtaattggggcatggatgcatgagctgtttcggttggttctgcggttggctgtgacctgtcacgttttgttgctttgcttggacacatccacagcccctgccacgcattaccccacgactatgcgactgatagaccactatagtgtttttactgtttttacagggcatgcagagacctcgtacgtccttggggttacttacgcatattacttttcgtgatactagtattcaaaaattgagaatggatacatctcaagaaaatgagaatgcatcaagcaatggcggagaccccaaatgaaaggggccaactacagagatgaaatcgatcgcttctagagaaaaaaaaaggaaaatgaatcaattacatcagataatcgttcttaagcatgaatgataatgtgtgcctgagagcacaaaacctctgtttccatgtttgattaatacatgatatataatatatgaccgtcatggacatgtgatttttttaatggaacatttaactatttaccatttttaagacgtggcgtgaataatttatcatttatagtttatgacaagtgggtccaggtaaactgttaaacatcacatctaacattggtaaatagttaaatatctttttaatgggtacgcaatgtttaaaattattttgagcaatgagaaaatattccatgatataacaacggaagaatatataaaagaaaatattttcatatcgctaaaagtatatcaaagcctcttatttatattcgtagtactaggatgagactcatcttataataagttgttaaattttatgccggagggagtgaatagtgataaatgtttcaaaaaaaatagtaatatagtcatataggacgcatcattaattgatgctatgcatgtcctaaaatgtcatctgtctaagatccaggcagtactccctccgtcccattttaaacgtagccatgacttttcgtgtccaaatttgatcatccatcattcgaactttttatgattagtaattttagtgttattagatgataaagtacttttatgcataacttatgttttttaatttttttttaaaaaaaattcaaacaagacgaacgatcaaaattagtttgcttggggtcagaccgccaagaatacatttccttatagttagctgccaagaaatctgaatatccctgactctttagacttagcggtatttacatggcggtcggccaacggaataattaaccttaatggttttcaggctatttttgaccgccaaggacattatattttcttgtagtgcacacgaaaacttatgtctgcgtttaaaatacgacggatggagtacttaactagctagcccctcctgcaaagtgcgaacttaatttatcttaacctgtgtatcaaggaggttccacagaatgacatgtaatcgatgcatgcatggaattaatggatattggacccctctatgtcttaaatatatatgaaaatgacgtggagcattgtagtccctaataatatgccctaaatagtactgtgactatgtaatgccgctaacgtactcagggacactgatactcttacactaatttgtctcaagtactgaaacccaacaccaacagtgcatgctaagcgcctaattaagcatctagccccatgcttggcgactggcagagcgttgaggagtgacttcaccagcttttgctgaccatccagagctagccatgacgatcacgaattcgctgatatatcgatctgccagccagtgtggatagatagatctgcatatatactagtcacgcatgctccttggcagggcg

SEQ ID NO: 109207 - DNA, 2221 bp, Oryza sativa
ggcagggacgaagcaggcgtggaggactggagggtgctctcgtccaccgcatgcgtgggtcgcgcatgcatctcacttggcggcacgcttggacatgaagcaggacagcgaggctgaagtgttgcgcgccgtgtgtgctgctgcccttcgacctcgcggtggtggtgttgctgccgtcgattcattcccctaccgtgtagctcgttgtcgatgacgactacgggaactccagtttcttgctgaccacgatgaaaagcgacgagtgtggcgcggttgtccaacctcgcaggcggcatccacaagcaccgaggtaggcggaaacatcgcccctgccctcgccggtcgcggcggcggcggctgtgaatggaccgaattgagtagcatactcattgggcttgtaggctgataatggagattggagaacggactgaaacgatttctcccatcagatgtgctacgaacaatgatccagagttggacatcctttgacatagaagcctccacgtcagtggatcttgtacccttcgttacaaagtgaaacaaaaaaaatcctaactataaacttaaacatagctttatagttgatttattttgagatggattcgtagctagtggttgatttattttgagatagagtgtgtagtagtacaagattatgtattgtcttgctccatttaagcatttcataacctgacaagtgctctatggactagcatttcatttaatcaaaatcgggtatgggaactcgtatggtgcatttaagctgctatagtgttatgaactttagtactccctccgtttcgaaatgtttgacactgttgactttttagcacatgtttaaccgttcgtcttattccaaaacttttgtgaaatatgtaaaattatatgcctacataaaaatatatttaataatgaatcaaatgataggaaaagaattaataattacttaaattttttgaataagacgaacggtcaaacatgtgctaaaaagtcaacggcgtcaaacatttcgaaacggagggagtactatgatactacaagccctttatttcagagatgacaagttgttcatgttcctagcatttttctttgcagaaagtcaaaacaggaggtgtgcatggcatcatttcagcaatgacaagttgtatatatttttccaatcaacctactacgggatcacagatgacaggttgaacaaaaaatggaaccttaagattatcaactaaaatgttttatttctcgaactagcaagtgagaatgcataggaagaattaaatataatttcaataactaaaataaaggcacccaagtccaaagtcaaaaagaactcgaaacctcaatggtgggggtgcatacccacacatcccaccggcggaggtagaatcagttcctcacttctcaaacaagcaagatgggcacttgatttttcctgtcactacttatctcatgattatcttaggtggacttatctgcttttgtagatgagcttgtttcatgctcaagtatgttggtagcgtcatggaattccatatggagcgcatgaaattagtatgtacaagaactctattatcttattagagaccctttaaacatgacaataccactaattgatggtactccatgaatcatacaagcttacatacaacagtttgtttgatacatgaatggcttttacagcatatctaagaatccttttatattgatcaaatgggccaacaattaacgtaaatgataatctcatcctaatatatgccatagaaaatccagcaagtctgcataaagtactgcatgctttcctcaatttcattgaggaaatttattaatatatccaactaatataaaacttagtatcagtctccaacaaatacaaaaaagtatatctaaaggtgaagctaaatggaattataagtataccaagctaaatggagctcgccgataaatgaaaatgcttatcaactctataaatagttagaattagccagaataagaccggaagaacctcatggatggtaggcaagtcacttcttccaggactacatcacgaggcttcataaattgacagaacagaatcatctcatcatccagtagcagaaaactggatgtcagcatctcgggaggcctttctgagcttcaataccctgcgcctgaactttgcctgctcaaggccatccatcgaaggcacaatagtcatcatctctaacattggtgtgttcttgagcag

SEQ ID NO: 109208 - DNA, 704 bp, Oryza sativa
tccgattcaaatttgaatttgaattcaaatattttttatatatagtatttctatacatctaaagtttatacacctaaagttcatagacccaaagtttataagtcaaaagtttacatacccgattcaaatttgaatttgaattatatctgattcaaatttgaatttgaattcaaatatttttttatatatagtatttctatacatttaaagtttatacacctaaagtttatagacacaaagtttataagtcaaaagtttacatgcccgattcaaatttgaatttgaattcaaatattagtttatagacccaaagtttataagttaaaagtttacatacccgtttcagttttgaatttgaattcaaatatttattgtgtaataagaagagaagaggaggagggagcgacggagcgtatagggaaggggcgggcgggtgatcacccacctattagccttaccctgtcttatatgcccatgaggcatgcccaacgcaggccataccctcggttgctatgtgggccaaagccacaaaaacgatctcatccccccaatggaagcaataccttcagatatacccttttcaaattaaagctgcacaatagattaattgcacaggtgcttcatgctacacaacgcggtgccacagcctaaacctagcctcagagcggcgcctcgcgtgagggtgcgcggagcgatcagagggt

SEQ ID NO: 109209 - DNA, 2393 bp, Oryza sativa
actgtcccaggttttttttgaggaaaaaaacttttaaatgtaactatagcagtacaaacacgcccaccattattcttaataaacgcacactatacatctaacgagaccatatatgaattgaagtgatttgttctttaaaatttagaccagtacagaccggttttgcaataattacgtacactacaaattttgaaatgaatatgcttatatgcctcaattatttgtctctgtctggttcctgcgacccagtgctcattgtgtctccatagcttggacaaggacaacaatgggtactgtggcaaaagtagcatgagttaattaataggcaaaaagttaatcgcacgagttaagctaagccctgaattttgggcgatgcatgattgattgctctagggcttatggagctatggtcattgctcgcatcactgaagtactgcttcatgttactcatgtggcctccttgtctcctcgtcattccctgtactgttaatccatgtgacattggtgtatatctgttgttcctaccctgattctcgtccttcatctagctggaaatgttataccttaagaataacaaatcacaaagttggattgttaactttcggagactgtctgctagctgcctagctggaccagttcctcaataatttacatattcgggaagataaaaattccatgtgccaacatttctgtcttgttttcaaccttaagatgaacatttcaggtcttgaaacccatctagaaattgggaataaatttttgacagaactttacaaattcaaacaagaactttaggggcaatttcctttgcttcgttgctcacgttgaatatcttttgtcccttgttgcctaggaaggagcccattctacgatattaaacttctgcaaatgtctaaaaaataaaggaatcataaacttcaagctttaatatagtttaatctgaataattacatcaaatgtttcgttttccaacattggcctcttctctttgccagcgtgtatgccattctctgtagtgtgaattgatcaatcttcctcaaattcactacttcttccttgttctctgcagcttcaggttcttaggtgtagttttattttgcttgtttaggacttccttaaagaattgaatgggtaggaaacgctcattctcaaggttaaggctgtgttcgtttgtgtgagatagggtgagaaaacacctcgttttccgtgcgcacgcttcccaaattactaaacggtgtgttttttgtaaaaattttctataggaaagttgctttaaaaaatcatattaatccatttttgaaatttaaaatagtttatactcaattaatcatgcgctaatggctcacctcgttttgcgtatcttcccaatcttttcaatcccctatctctcaaattgtaacatcctgaaaattctcaataataaaaatcactaaaattttgaactttttaaaacttttgcatcatgctggttgttataactgctattgctttccaaaccgtaaatgattacaaagaaagtaaagaaaagaactacatttaagcaatagatataatttaagagagttattatttatgtttaaccctacaagtatttatgcacaaaagttccaaattgcattcgggggttgaaatttaatagattaaacccctccataaaataaactaacatataaataaattgagctaatgtgttactgcgttaataacggtctcattaggaaattatagaatctttaataaatcttaaatatcggacaatattaaattttgggaaaattcacatttggacacttaatatggtcacccaaatgcttaggagtaatacaaatttaatttataacttttcccaatttataaatcaaccaaagccctaaaagtaggaaaataggaatacttagaaaaatatataataaaaataaaaataagttcaatattaaatttgaatacaaatttcaatggaataacttaggattggtgtatttttacattgtgacaaaattagtggcaacaatatatttttcctaattgcaaagtaccctctaaattcaaaaatagttggctagcactgttcattagcccctaggtgttcgatttggtttctagccatcctagctctctttctccccactgttgcgccgccctagccggcctcgagccccgcccgcaccggcgccgtcgccgtcgcctcgctctgccaccgctgccgcgccgccgcatcatgtcgcgtcgccgtcgccgcgccgtctccaacccgccgtcggctgcgccgcgccgctcgtgtcaccgtcgccgtcacccgcgtcgcgccgagcctcgcaccagtcgcgtcgccgtcgccgtcgcatcagtgcctcgcgccccgtgcgccgctgccgcgccatcgcgtcaccgcg

SEQ ID NO: 109210 - DNA, 719 bp, Oryza sativa
tcatgtttgattttaaaatcttaatgacaataaaaaaaggagacagcgggcgagccataaagagtacaatggcaaaaccgctgacggtttggcgggacttataaaaagtaaaaaaaatgaactcgaacgataattatgttcgatttgtaaaatcccaatgacaataaagagaaaagacatttgacgggccgtagaggagtataatggtagtgtttgacaagacttccagaaattataaaaacgaaacccaacgagataataaactcaaaaaacaaatccaatttttaaaggtttcaatgaacgaaacccaatgagataataaactcaaaaaacagatccaatttttaaaggtttcaaggagaatgaatagaaatagtggtagaccgagcaagcaaataaagaagatatgacagaagtaaggggtagcagctggtgtgacttttaaaaactatatagttagaaatacggggatgatacggggataactatttaacaaatttaaagtaaaatcatactaaaaaaatatatgattttgtttaggtgctagccgtgcaagtgagcgggccacccagctagttcgatttatatgaatgaggtatagaaaaacctcttaaaaagtcctatgaattatgtgtacatactcatattccttcacttttattattcctatgagttaaaattctgatgccttcctccttggtgtgcagggctgcaggaat

SEQ ID NO: 109211 - DNA, 1486 bp, Oryza sativa
aaattagaatattttacaacaaatgtgattgttggtagttagatttctgagcgatccaaccaggacaagccgatcaaaattctgctataaagctgggcagctcatggcccataacctaccacctcgctacccatgatctttgaatctatttgatgacgacacctccaaattcagccgctcgccatgcatgcccaccactctgccataatgccatagcatgctcgtgcattcctctccttccaaacacacgagtgatttttttccttaataataaaaatagtttacatctccaacatgcacatagcatcccgctgctcatgtgatagtattaaatatcaagtatgaaaccaactagtgtgaaagggcatctagcctaggtattgtagtgacctaagtagcacctaaggtcatgagttcaaatcttcgtaagagtgaatttcatattggtttatttaagggctaagtttcttgtttgtggtcctgagtttaaatctctatagaaccaaatttcagatcggttatttgatggctaagtttcaattggatgtaaaagctgcgtaaaaaatactcttctctatataaaaaataaagccaactagtagacgtaaagataatcttcctagattagctaatttcttatcatttcaatatcgttaaattgaccaacataaaactctgtcttcaaataaaattattatttttgggaccgctcggatttatcttttcggttagctcctccatggcatctggcagcaggagatatacaggcacggctgggtcctcttccagacctgtcttgtgtagctacaactgatgaaaagatgatggcgtgtctccgggtcttcagcacaaagggggcagcttcgtcgatgattttgttttttgaaagaccttggtgtgattttctttctcaagccaatcataaattcataatggtactgaatatctaccagaactaatggccggtaagcatgaatggcatgtggttatgtacattgatcttctcgtgttatgatctaaggagagaaaaaaacgaaaatgatgaatattataaattatcttaggcctgttatcgaatggaggattctccattttaatgagaatcgaaccaattcctattaaaatcctgtaaaaatgttgggcaatttttataggactgtcacatgaagtagttcatttcccataaaaatcctcttaaattcccatgaaatgaattgcatatcctgatatccacccaactgtagcagctttatgtcactggtggagaagtgttttttagtcccggttcgtaacccccctacagtcccggttttcaaaccgggactaccaatccgggactaaagatcgctatctttagtcccgggtgaaaaaaccgggactaaagatcgatctttagtcccggattggtagtcccgggcgttgactaccgagacagtcggggggtgacgaaccgggactgactaacacttgtccaccagtgacatat

SEQ ID NO: 109212 - DNA, 1182 bp, Oryza sativa
aatagtatgataaaatttcgttaggccccgacgatgggggttggttgaagaaagtgaagggattatggttgaggggaattagagtgttaagtttttatgtatcaattttaaatgggctttttgggtcttcattattgcaataggctacttttatagaagtaactcacatccaggatctctccggatcaccaacgggttaattctaatccgcgctgccatcgccggaattttgcgggccctctccccgctcaaccgcggatgagaattcttccttggccccagtcccaatagagaaattaccacccctacatatacctacatatattaagttctttcatgaaaattatgggcatttccgagaatacagtgaatacccactgcttctgccactcaacgatgacctaagttggtaaaatccgatggtgacatcagcggcagagctagaaaatctgcatgtgtacggtgagctaacgggagctcaaatatttttctagaataacatagcaatttttaaaatttaataaggattatggagctaggcataggagaaggagataaggatttttccagggtttatattattgtcggtaaccacgcggttatcgtggttactggccttaccgcggggtacggtaatagaaaaaccgcggtaacctccttaaattcaaataaattttaaaaataatttgaatttttaataaattctgcacggtttcgtgcggtttttcacggttaccgcggttaccacggattgggtgcggttttttaatatatatatatatatatatatatatatatatatatatatatcagaatttattggatgcatgcattatatttattagggtgatttaaactaggagatgataataattgtttcttggtctttgggttaagggtagttgtgccttatattttggaatggagggagtaagagattttggatgaatgtgacatatcctaatactatgaatctgtacagagtattaataactattataaatttaaaaacattttttttatttttaaagaaaactttattcacgatattcatagtttagcagtttggtaagcgtgctcttaataaatgaataagaagcctagcaaaagagctctttagaacgcatcctaagaggtcttcttgttggaaccaaaccctcgcattttaagaggcattcaagg

SEQ ID NO: 109213 - DNA, 731 bp, Oryza sativa
tcctgcagcccttcgtactaaaatataacaacttcgtattcaaaatttgttccagaatatatataacaatttcttcacctacattctcttcttaacctatcacaatcttctatcattcaaattctataccaactttctcttctcaatcaatcacaactttcttccatttaattctaccatcttttttaatacctgtgtctgagcctaaaactctttatattttaagacggaggtagtatatatgaaaataactcctctctcggtaaaaaaagaactataaatatgaatctacatataggacagcgggagtatatgatggacggaaagaacggcggactgaagctacaagtgcagaaccacaaaaaggatggttaagcacttaagcttatctaatccttcttgctttggaagaactgcctgcttgcgttcagtatataaaaaatttaactctcctgtattaaaaaaaaaaagaacaggcagttctcctgacgatcttcactaaaaaaaagcaataaaagctgaaaagctgggcagattcttgcagaagattatagtactcgtatgatcttgtctgttggagtagtcgctacttgtactggcatgtgcacgcttccatgtttctactcctacaagtttaatactagtactaatatatataccatgtatctactctacgagttcagtactagtatatgtacaactcatcgtgacagtgtgagtagtaagcagtg

SEQ ID NO: 109214 - DNA, 697 bp, Oryza sativa
tcttttgaagatggagacgaagatagaacttaagtgtttcacgtaaagccaggtggtagtaacgtgtaattcattgagccttaattattacaaacttgagcaatggattagtcatatatcctaccacagcttttatatacaaagttttcgcacgaaacgctctcgtttagcatattgaaaagcgtgccccgagtattcatcatttcatccacccttttcatgagaatcagacgctttaagatagcgtttgatccgtccatggtaagataagtcaggttcgagagtgtaaattttatcccacaaagactgagttctaccatcctacctatcctcagttaggggtgtaaacgagccgagctgagcatggaataggtcgtgaaagcatggtgcaagggaagtacggctcggctcgtttatgggataagatggctcgcgagagtggccttgagtaaatctcaagcagatataagaggaatcgaactacagtataccacatagaatgtgtaataatgtgatgatttttatgtgataggtcatcagatcgcatagatatataatatgacaatagtaagtaatcatttttagcgaataaatagttaggaaaggagcaagattttagcatatggccctatagcagtgagtcaagcgagctcacgagcccaagctttttgtccacccctaccctcagcacgtaaaa

SEQ ID NO: 109215 - DNA, 510 bp, Oryza sativa
gtttgaaaggaacatgtcctaagggcaatcccaacctaaggcgttcataagtagagcctatggcgccatgtcaataagacgtcacaattaaaactatctctacagcccatcttgtttaaattagaccctggataactacgtcatggtacttatctaccaatcatcggtatgctttatctatattgaagacaatgttctctgccatagcaaaacttgataattctttcccactgcggaacttgatagagtctattgcttatgtgctgaagatgaagaggtgtcttgcatgacaccctaatggttcatgtattctctctctatcaatgaatatagtgccggataaactaaaagtgctacatggcaatgtagtagatgccattgacaccctcctagatggagggctggaactgccctctgaaatgttgctaacgatacattctagggtataacggaaggaggattctttgcgtgcacatatatgtatgatactgaaatggatagtagtgctca

SEQ ID NO: 109216 - DNA, 949 bp, Oryza sativa
acacagtcaactgacggtaatggcatgagagggtgcgcaaatttgaactaatggcatataggggaagagccaatttttagtggcatataaaggatcaaaccaattttcaatggcatataaggaattctctcttcaaaaaaagagagggccggttctgtttgtcacctataggtaccagccagtaaatgcttggtttgaaacttcacgttatgaaataaagtgaacctattgagtttgaaatgtgtcatccacagcaaagtgtgatgcatggcaaatttctttggccagtcctttggtatgttttccaatttacaatctctataaccatgcgtgggttttactagattagcatcttctactgcagggactagacacaactagcaacaattttttatatgctgcggtgtgcaaactaaatacactaaaattcggtggtggataactgtggataccagtcaaattaccaaacttagtatcacctttctgtcaggagcatactgcggcttactagtatttttaccatactactacacgaccagaaatgcagatgtgctgtgtctgcataaaataattacacacattcctcttttatctccaatgaacttgatgggtatggctataaatgaatcaaatgattctacctgtgacaagctgtcagtcacatgtcccccgagaagttgagctcacgaattgtaggaaacatgtacatggagccaagataggtgtgtgaaattgcatgcttgacgcaaagaaattgagtgttacgcttttctattccggctcgaagcatatgcatagcttctatgttactccctccatttcgaaatgtttgacaccgttgactttttagcacatgtttgaccgttcgtcttattcaaaaaattttatgaaatatgtaaaattatatgcctacataaaaatatatttaacaatgaatcaaatgatagga

SEQ ID NO: 109217 - DNA, 741 bp, Oryza sativa
ctgcagccctgcatatttgctgtgtggcttgttgagtatgtcatatgctcaatcttgcaatattcattcatcagaggagtacttcggtgaaggtgatgatctggaggattaggctttgttcgggtcaagttgcttgtggagtggagtcgccatagctgttccatcttttgtttttatttccgctgcgtagaattttattcttttgagaggaactatccacctctgtaataattatttatttcgcgagtattaattagatgtttgatagtactctattatcaatttgttattgtgtgcctcggctgattcctagacgaggatttaacgcacgtgtaagcatttggaattttggatagaaattccgggcgcgacaagttggtatcagagctaccttgaccttacgataagccaaatggtaaaccttaagtagccttcaaaatattttgaaaaataggactgctcttctctattctcttacaaattaattaagttggcagcacatgcaaggttatgtaccaaatttactaaatcctactttaccaaaacagaaacatgttcttttatttaaaaaaaaactttactgttcagggtattaaatagtttaattttctgaatttcattggttagtcggcactgtacatctattatggtatcgattcaatcaagatagcaccagcactactcatccctgttaatggtgacactataccgtgcttatggtagatcctaagtattttagtt

SEQ ID NO: 109218 - DNA, 1304 bp, Oryza sativa
  unsure (1)..(1304): unsure at all n locations
tcggttatgggcaagctgagcaatgtacccaagtcagtgttttaattcttaaaatttgctcaacaattaaaatgtggaatggttggcctgggttggcttgggacgagctgggacccagggtcgggttgccagttcggtctgaatcatcgtaggccttgggttaaggcaggttcgtgagggttcacggccttgtttaataacattgtgtagctctaggatcgtccttataaatggctttgggcaactaagtgacttttaaatgctgtttactgcaaaacttaaccccaatattattatccccttgtacccccttgcattaatcatgcatccgccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacactccgcgactgcccaacacatgagcctcgtcccgacacatgagacgcgtcacggcaaagcttttcgataacctcgcattggcagtacccgctccatgaacatanatcctcatgaactctaggcgtccatgtttctagcagtgagaggagttctggcgctcccgggaaagagaaatctcacatacatattatattagggttcaagttaagttctctctcacacacactcatggcagtcctaccaatggcgacaccgatgtagggctcgcctctcggccctacctcaacggctgttccaccgtagcgcacctgcctcactctggggtgaaccatctatgcagggatactgcctccgctcggctatctagtccgctaggtctatacccatacgagaagtgtggttgtacgggggtcgtttcatgcttaacttcatggctcagtccttaattgaccggggacggtactagccttttccagataccacccaaatcctccgtccgccccagtcgaaaacagttgttcccactttattttcctttcacaaatcatgtcatcaatttcatggcaatgtggcgctcatgtcttcacatgccgcatctcaattaccttcccaaaggtaattgcccaagcatttagcatttgata

SEQ ID NO: 109219 - DNA, 2306 bp, Oryza sativa
tagtagatcggctggttgtggaatggctgtttggttatcccatgagagtttgttaatcagagtgatcgagttgaattgcgaaattcgcgttttaaatacccaagttctgttggaaatggcgtcgagtcgcccggtaagttggtgcggctgtggctataatgggcatagacgcacagtgtgcccacggattgatggtagcgaggcgcgaggcgcgaggcgtggtgaatttcatccctgttgcatggttgctggggctgctgactggaccatggtgtgttgctatctgctagtcactgcttgctaggcatggctatggcagcatccaagctgtggcttcacccgtgcctcctgccgccaagcagaaggtgcaaccactgctctggtcgagctggcagtctggctctgatgtggcatggtgagaccactcgccatgtacctgtgttgggcagggcctaagatgcaaagtgctgcaggtgttaggtctataggaagaaagcatatacggggtttttgagctagcacattaggtagtgcatgcattggcgtgctgttcataaagggactctactaccgttttagattttatttgggcttccttttcttctcaatggatgtccatgggcataagggtaatgctgtagcatgaatgcatgattaatgattaaattttattttgcagaattattaagatagatgggtacaccaggtttcagacttgtaatgtcctttttttttttctgaaagtcacatgggagttggtatttattttctcctatcatgctatatatgtatcaccagtaagaatttttatgatagcatagagagtgcatgtgatgtatggaatagttaatcatctcactatttagtagtatttgttaaacgagtggagccaaggtgacattgtgcacgaagtaaaaacagcttatagctgtcagacaaaacttagttgcttgctgcagtttcttatatttcccagcaaaggttgggactatgcaaagcagcgcgaaggtcctagtggttatgacacctcatacgttcggttatccacagtgattttatctaataatcagtatgtataggttttaaaagtgattccagatgtcctgtaagttataggggtgccactgtgccagtatgtctctaatattgttttaaacaggctagttcttcacactgtaggtaaggttgattacgggtgttttagtttatctcatgttcctattgtgggaagagaagctaacacatgttcatgttcttgagtaaatcctagtttaaacttgcacatgtgtttgtttttctttttttgattccatatttccatgcgttgagataaaggcatagagtaagggataatgtgagaacaattgtgggcccagccattactttgtttttggccttttgcgcaattggagcttatgctaatttcatgaatatattctagttcacttgcatggcaaatctataaagactgtacatcactacatccttatgttgtacaggtagttaggccttaagacaaactcatattgtactagaatcagatgtgcaaatgtcacttcatgatgcatgtttgttccaaatattatcccatcactggcaagatgccaggattcatgtagtgttatgtagcacgataactcccttctttttttttttgacaatgtgcacgattactatgagaattcacaaaccctaaattcacgattactaaccctaaattcttatttattgttcggcttcatatccatctttgttttactagatacacttttatgttatttataaaaacttggttcaattacatgagcagctgagcgccacttatgtcatgccaaaaataatgttcaaatctagagatgatgggtctcttcaaaaaaaaaatctagagatgatgggattattattttgtttaaattttatgaaagctctgtaggaaatcaatatttgtaattacttgcctgttatatacctactttaacaaaaagggaccttgtatgcggagttggggactgctttgatttgataaacacaccattattatctttctcattaaactgtacattaattataagtgccctagaggtaaattgtttgaactgtatttgtgtcttctttcacatctttacatgacattaataattttttttactgaatcattcattaattattatttactgaagtgccctagaggtaaattgtttgaactgtatttgtgtcttctttcaccatcttatcttgatgacatgtaatatgtaactaactgagtaatggctgcgttctggacaggctgcatcaccaccaaggag

SEQ ID NO: 109220 - DNA, 659 bp, Oryza sativa
atgtattaatactctgatttgggaagaaaagaagtatcaaaaccctcaaatatcttttctcagtaagtaaattagatctaggaaccctagttttaggtctttgcggcgtacacatatcgtatcgatctctttcgggttccatttctagttctctgaatattgagggcttgacaaaggtatcggagcaaagttcaatccttggctctcggattcgaaaggtgcaggttggtggcgatctgaggatctgccgctgtaaaatcccgacgctggaagaattcgatccggtggcgacggtgggtctcaatctttggagaagggttggcaggaggctgtaaagtccccggatccaaatccttgagacaggcggcggtagaccagttctgtgaggcgatacagggcgggagaaatcctgaactgccgtcacagatcggagagattccatgtatggtaagcaagactcgttctcacggttcactggtggatatggaggagatgaacgaggtgcgtactgagttggctgggatgaagaaagacttattagatctgaagaatcttaaatcagaagtgagggaggtcaagaagttgctacaagaactttgcaagcagaaagggggagaaactggaaatactgaggcaggaggaggagctacgggtggaat

SEQ ID NO: 109221 - DNA, 1056 bp, Oryza sativa
ttctctcaagatatatatcgcccaataaaaataaaaccttaaaaattggaagacaaaacataagaccataagtttcgacggggattcattatttttaaccaacagatatacttttacaaaagacttaagcagacatgtgttacttgttaaaagttatgaaaagaaaatgaccaatggatattataagaaaaaaaaatgggatcatcggttttcacctaaatcatttaggaaaaattagaaaaaaaaaccacccctccccttcgttctgccttgcatatatgcagaacacaaacactaccagtacaattccttgttggcgtcactctacctctcccagtttttctatagcaagaaataataaaaaaatattaaaatgtgcatgatttttaatctgcacatgtgatttctaatgtaagtattgttgtatttataattgaaccaacaatttaaagatccataacgcctatattttcaactagtataaagtaaatcagaaaatagaaaatctcaatacagtcaaaaattgaaatatttggagaaaatgtaataagtttgtaaaaagatatggttcttactttcactaaaattggaccaatcattgcacgttccattttcataacaatttttaattgcttagatgttaacgaccttagatttgtactaaatcatagcattatgagtttatccatatattattgcacaaatagttccttgaaaagttatatttattactatcaaattcaaaactttggattcctgttaacaaggtacttttgtttagaaaaggtagtataaatcgaatatcacaagaaagcaagggctacaatgtgtcgttattaatttatatgtaagtataacaactttcatcaatttcaaactagaaggagggctacttcatggtacaaataaaacatatttattaaaaataatagttctttaggatttgttaaaaaaaagcaactaaacattcgattaaacaagacaaaatgctttgacacgttttccaaacaaactaaatctaactcctttctaaataatgaagagatcatggataat

SEQ ID NO: 109222 - DNA, 525 bp, Oryza sativa
attcgatcagtgcacacagccatacacccggtacggcacagcttctagtgaaaccgcacctttaatcttgtcaccttatgcatgagcaccagtcgcgctctcgctagctcgctttagccgatcagcccggtcgccgtgcaccggtcgcggctgccattggcacgcaggagcagccgcgaagcagggctagcgcggccgacacgatcgaacaactcagaccccgcgaacactccatgcgacacgcgcggttgcggaacatatcatgacaagctcgcgttcgcgcgcctctcgatcgaacacgcatcattctactactacacgtccattccatccggccatgattccccttctcgccgcggccagccggcagggccctgctccacacgccggtgtcccagcggatcgcacggcttttggcccgagagaatgcaagggaagagaacgagagagggagtgagggacagagagacccccgaccggctggccggccggccggccaggaagacgagagccacggatcgagat

SEQ ID NO: 109223 - DNA, 1462 bp, Oryza sativa
cactgtgacatgcagatagccatgtcttattaaatggtggtagtttttagctgccacaacaaaattgtgtatagccaatggaaacaaaacttatgtgaaataaacaaaataagcagatattatattactaaatttctatccatgtagactaaaaagagaatatgttgttcttacatggtcccatcctcctcgttttgcaacaaagcatcatacctaatctagtgcgtggtgattctgaagattaccgttggctacaaatttgtattgtctaacaagatattattgtgacttagccatatacctcaaaatttagcgcttgtcaaaaccaaaatttgattctttagcttttaatttgtttacccggtatagttacattgcccatattgtagaaatactatcgtctggtggaagaccaaaagctatttgaattgtacaccaaataacatttagcaaaagggcgataaaaatagatgtgtggtactctttctttagaattacaaaatgcgacatttggatctatacgtctgtaactgtccttttggctaaattatctttggttaggattactccagtaacatttgaaacctttattttgagggaattttcacattccatatatagcggtccattatttgtcaatcctctatatatatagaatgagctttgaaccatccatactggtgtaaaagactatcaaaaagtgtcatattggtaattgagttctatttccatttttttatctacaagctcactatatctcttcgtaaagaatattttagaggtttataatttaaaacctccgtgactgttgcactttggttcgttacaatgcaatatatcatttgatattgatgttttttattttttcacacaatagcatgttataattaattagtagcatcacaacctatattcagactcttaaatggatattcacgatatacaaacctagtcggcactattgtaactcattttctataccctattatagaaccaaagtggtcacggttatagtgaatcagctacaccacctcctactgatattctaacaggtgccacctcctccttacatcatgatagttaggaccataccatccttaatctagagcatttattacatcctatggctttaggttcaaggtaaataagggcatgtatataagggacgcttgcacctttgataaacactaacaccatggccgcagatatatagtgagcaaaggagaacattatccggagttgcctttttacatagtaaaaagcctttttttttaatgaacgatggacatgaagattgatgggtcaaatttagtacctctatgatgatttttttgtatattcacaaccctagtgaggtctgctgctttgccaggacactcgtattttataccgtttaaatataacacggtttttgcacattatacatcattttgtgtaacttttcaaatcattataaaactgg

SEQ ID NO: 109224 - DNA, 565 bp, Oryza sativa
tcaatttaagttaaaatttcaaaactcctaccaccaatcttgtttttgcatgaacacatatcacataaagcaaagctttcatttagtgattgtttactttcacttaatctgttggtgaaaagctgttactgtcctgatatttatattaaccattatacactaacacctttttttcattttaaaggttcaagttgcaaagaatattacgaaggggaactaatctgcaggcacgcagtgatcaccggtcaatgaatctccagcatgcatgaaaaatttgatcaaataaactatttctttccacatatcaatgttttgcgatgtgatttgaatgtattgtatttttttccttacgccattggagtttttctgccaatctggcaactgttaatcttttatctgaaaataaatgttgtatgtgagataagcaacaccagattcatgttacagtgcttgtgattgtctactaataattattactcttctctttgtgtaattgtgattctcaacataaatttacagtgattgtgtctcctaatgcaaatattttacttatagagtggagtac

SEQ ID NO: 109225 - DNA, 749 bp, Oryza sativa
ttcgccttcatttctttgcggagccttgccagcctggttccttccctgattccccatattaaagttctggtttctgtttctgttaatgctaaaggaattcctctttgcatttgcagctttctcatatgtcttagcataccaatatgactctagtaagccctgtggtttttgcccacaaacatcatgtttaatgtcacttctgagtcccccaataaaacaactggtaatgtattgctcttgtaaataagggtgatctcttctcactaaatcaacatattcctcaaacttatcaatatactgctcaacagtcatcccatactgcttgacattctgaaataattccactgcctcatgaacattggctgctgaaaatctagtactaatcatggcacaccactgtggccatgagatgatctgccaaggtagccccactcccctgaaccacttagcagcccttccttggaaatgagctaaagacatattgacccattgatccatcggtgttccagtcagctcgaaaaatttctcacattgcttaagccaatcgataggatcatcaccattgaacagaggtatttccaacctagggcccttgagtactgcttcagcatagtgacctccatcaccctggtgtcccacatagaaatttctctgctcatcaaacatccttactctaggattcccttgattttgctcgtaaaacatctcatgtctatgctgaaattgtggtggcctatactaattaaact

SEQ ID NO: 109226 - DNA, 676 bp, Oryza sativa
ataaattaaaaaaataacgcacgtctgacaaagtagttaacctgggtgaaaatgaagccttaaaaaataaattcttcataaagaagactggcgtcatgaatcaggaattattaattcctgtattgcctttcatttgcatcagctaattattaaaatatgatattgtccttgtctatgttacagcttcatggctagtcaaagaaattcccatagactcgtgatgaacgaactcaagagtcaaccaataattgggaaagcgatctcaacatcagttgaaaactggctcgtttcaacatcagttgcagatatatagcgcacatgattattcagtggaggatttcctagcagcttcgctaattagagaactattattcctgaattacctttcattagtactatgtcacttcttggattgaattcgccgcagttgaatgttcagagattacgtagcaaatactccacggatgatgagccgaagcaattgatctctcagctcgtctgacaaatcaaggtttgagatttattatctctgcttcttaatcattgatgtatacatagtttaaaatataccaatgtcaaaatgatattggaagttaactgaaatattcagacgtatgcgagtacaggtaagtccctttttttttttttatgttcgtgtctcctttgaagtttgaac

SEQ ID NO: 109227 - DNA, 2602 bp, Oryza sativa
ccatgcccggacttttctctcatttgctagagtccaatgtaattctttgtcagtataaaatagagttgatgcttaggcaattccattgtcgggattcctgactcgcacaaaccccgtgcattcttactatggccccattgtgctctgacttgttctctaatttgttaggcctcgaaataaatcttaggagagttaaggatgttactgccatcgacaatattgaccacagtagacaaatttactcctacaaataacatagtacaaaggagagttgagataatcatttaagttatagtttatatgttatttctcatgaaaggttgtcttttcgtgatatgatattagacatgctctctctactacaaaattacgcttttccgtatgaatttttattaattgttgtctccatcgacggccacgtgtagccttggaagtgtcctaatggacctttctagcactcccgttggtccatgtagaatagttttcataccacataagttaaaaatctaatgcgtgcaacttgagttaattattgacgatttccctactccatgattttgttagtatgcttatatactcccacgatatttttattcatttactatatatttataatttcagaatataaagatggagctttgttaatccaggtgagggggagggggaatgggatggtactttgtttttttatagtttttctttaaatatagatctaatgactgaaataatgattttattgaggtcggatgcttcattcttttagaatttatgtgatttttattaatttttaagatgtgatacgtagcggcttatgagagtagaatgatatatctaatggctgaaattaatacgtctgccgatttaagtgtaaaatgatagtaggatgttttgctttttatttctcatagaatttcaacgatatttcttaatttttaagatgtgaagggtgatggtttgtgtcctacatgatatttaatttaatgtgcatatgtatatatagaatgatttaagatgatatagttgttgtcaattttttttatattgtttaatgactgacatgctagggtctatgtccaaacgtatttcagttttttctttaccttcgcaaaatatatgcaataccgatcttgatgtatttatttaattacaaatgaaaatagtacaaatgaatcaaatgttgtatataaattgagaatcatggttatttagctatttaaaatttaaactattttgtaatgagttgttagaaaataggagaaaaggggagggcatatggaatacgtatcacatatttacgtacatacgtacgttggcatgtacggcaggggaagggaagggtacatattctgtgagatcgatctagtaggcccatatgttggattgagtatatattgctttaaaattgatctaatggttaaaactaatgggtccactgatttaagtgaaaatcaatggtgagatgctttttttaaaaaaatttctaggattttttctaatttatcagagcgccacatggcgatttaggagtgtttatagagcgccacatgacgacttaagagcgtttctaggaagtttaatgaacttttagtatataatatagtatataatagataatcgtacggtcatctggaattaatatatagtagctaagtgatactgggtactgatggcgtgcttgtatacaaccagttgtatattacttcctccgtcccaaaataattatcattatagatagtttaacatacattactataaaaataatttttctatatgagaacccctataaattgcgggcggaccgtaactagtcgtgtatgcaaaaatcgatctctattttcgcatacggctccttaagaggctcacatacaaaactatatatattttcgcagctgcataaaaaaataagcctattttcgtatgtggggtgcgaaaatattttctcttctccacagttttttctcctatcctttctctttgtcttctcacaacttcaattttttttcacctcctctcctctctctctgtctctctctctcctgatattttcctctcctctcccctatctcttcctctcctctccgagcgagagccggtgggcagcgggcagtggcgccaacaaggaggcagcagggagcaggcggcggtgggtggcgggaagctcagcgacctcgggccgcggtgccactatagaaggagaaatccttctcacttcataacacacactcaagaagcaatttctctattctatatttgtatactctctagtttagtagagtttaggcttagaatagttgttcggtttcctagttttctcatagattcgagcatgcatgcttttagtactttacttttgttgtaagactatgagctcaataataaaattatcttctttatttgattgtgtttgtagttcatatactgctctgtctattacatggcctataagtagtttatacctctttcgtatcactggtggaaaaaccatctttcctcccggttcgcaacctccctgtagtcccggttattcaaccgggattaaatatcgctatctttagtcccgggtgaaataaccgagactaaagattgatctttagtcccggtt

SEQ ID NO: 109228 - DNA, 630 bp, Oryza sativa
ctacttttgcttcgttcattttcctacggcatatcaaccgtccctcaaacgattagagccactgtgacatcaaactaatggagtaatggagtactattcttgggcaaatttgacaaagaaaaatattgaaagcatcagtacatgaaactaacaagcaagctctaaccaaaggggctttgcgccccctacaccataaatattttctttctcagcgtctcaatgtgcataatatatgattatcatatatatcaacctttgcaatgcaaagtcctaccgctaatgagtttgaaaactgtttaattttgttctatgagtatatgaaagctcttatattagatttatctagataaatgcttcacaataggaaaaatgtggatcttgctccctcgaactatttctccaaagcactaaactatataagtgttttcagctcacattaaccttcaaactacgtacttaaagaggctgactgtctatataaaaaattatcgtttcttctgcttatacaaaccatgatttaagttaatatttcgtggaaccatatatagaacagaataatatatattgcaaaatatttttatttatttttatgtcaatttgaatgcagttttaaatctgggctgcaggaat

SEQ ID NO: 109229 - DNA, 725 bp, Oryza sativa
acggttgctgctcctagttatatggaaaccctccaccaccactccagtcacctctcaaaataaatataaggtatttccaaagcaccattaagttcttctataatatattatcaacaaataagaatttaacatcttgtataattactttgtttgcatccgcttagctgctcaagctactcacatacacaacaatcaaggccccacattggctcaccttatttttctccaatacgttgaagttatggctccaatgtatataaacacaccaacttcaccatcaccatgcttctcacttcagcacttacacgaccactcaagctcaccatatataaacaattaaagggctcccgcattagctagtcttggtgagaatcaccgttgaagcacatatccttctcaatttgtttttttagtttataaagattagatctaatagttggaaataacgtgttgactgatttaagtgacaatcaagagccgtacgtttttatttttctcagaatttctagaattttttctaatttattagaatatcacgtggtggtttaggagcatttgtagtagtcttgagagcgtttgcagcaaattcaatggacttttagtatataatagatttatgaatgtataaatttggctgatttttacttggattttttattatattttaaacttatgatacttctctcaaaaatctatttgggattgctctgaaatttggttatgat

SEQ ID NO: 109230 - DNA, 2036 bp, Oryza sativa
tctcctcttatcatccagaaaaaagagcaagtgcagaaaatctgttcttatgcatacaaaaagagcaagtgcagaaaatctgttcttatgcataaaaaaagaacaagtgtagaggtatataaccaatgaatcaagcagaataaatttaaaaaacagcagcagcaagggtacagaatttgcatgattgacataaaacagcagcaggagaagtataataaggaacacattgggcagcagcagcaagggtatataaatcatcaaagaatgacagaaaacaagtgtatatagtctcctcttatcaatccagaaaaaagagcaagtgcagaaaatctgttcttatgcataaaaaaagaacaagtgtagataatttgttcttattgagcaattcatcactggccatttaacaaggaacacattgggcagcagcaacaggggcaaagatactccacaggggcagcaacaataggggtgtattaacataaaacatcactggccatttatctagttaaaatcatgcaaaattcaaccaatgcagcaaaattaatcctaaaatcatctaatacaaaaagactaattcatctaatactgcatatatttcatccacaaatagtccaaattcatcacctcatatatttcacatctcaaatatgcatatatttcatcaaaaaaaatgagacagtactactaacttcatgtaaacagcaattcatccattcaattcaatcaagtgtagataataaaacagcccataatcatttatgtggcagcagcagcaagggtatataaatcatgtatataaacaacaattcatgcaattcacctattcatagacaaaaagggtatataaatcaacaagtttagataatctgcaaagttccttaatcatcaaagaatgacagaaaacaaaatgcatggagaattttggtgtctaggtcggttccgtccatggactacactgaccaatccaccaaaattccccatgcattttgtattctgtgatggtttgataacctcggaacaacattaaatctgcggccaatcaatcaattcttccatttgaactaaatttcaaaccctaaacctaataaagttccttaattatcaaagaatgacagaaaacaaaatgcatgaaaaattttggtgactaggtcggttccgtccatggactacactaaccaatccaccaaaactccccatgcattttgtattttccatttgaactaaatttcaaaccctgtatatgctttatttaatagttctagcaaaagggaacaaaacaacatataaagcagtacacactccatgaatggttagatatctcaaggtactttcttaaggaccataaaatttctctaaatttgatagacaacataaatgaattatggattcaggaggctagtgcttaagtaaatgtatacacatgttactccagtgctctcagatttatggtatccctccgagttaccagaaaaaagaacactccaaaataaaaaggatgcagaaaccagagtgatgcgcctatctaaaagaagtcctgatatcccaaccaaatactaaaagatatcatcaaggtgaaaaaagagagaaggtcatgcttgtacacagaaaactgaagatgtataactctatcggattggcagatcaccttaactcatagcttatcaaaacatgcaacaatctgaacggaatgacaaaattcatcgttcatccaaagttcatcattcatccaaagttcatcattcattcatccattccattgcatcatttattcatccatccactgcaccattccattcatgggcatcagagagagaggggtacctggagagggggtacgacgagtcccggcaggcgcacggcgcacggcttctcagcacggcggcgcggcggcacacggcgacaacgagtcccggcaggcgcacggcttctcagcacggcggcgcggcggcggcttcttggcacggcggcgctgaggaggagaagagggggttaatcggcgaccaatagtaaacgaggggaggcggggggagtgggct

SEQ ID NO: 109231 - DNA, 700 bp, Oryza sativa
gttgctaccttcgggttggttgccatcaccggtattagcactcctcctggttgtcaccatctgaaataccccaaaacaaaccaaccaacagagggagcagactattaaaactaaccacccacgactaccaaaattcttgaatttattactgctattaaattggttcattgaggttcaagttgcttaagcaaataaaataaagacaggctccgacacagtcataccacataccggtacaaccatgccccacgcgactccaacaggaagacaaacgagaaagaacacacgcgcgagcctactaactgcccgtctacttctgcgacgggccagggcggaaggtgagcagcagcgcatcctccgtgctaccaacgccggaggcttcccctcctgaggaaccacgggcgcgggctcggcacgaggggtctccacgaagcaggtccatgccagggactgacgaacaagctcaggcctggaggtgctcttacgggcggtgatcttctggctgcagcagacgcggcgacacttgggacggcagacctctccctgggcgaccttgagttgacacagctgcgcctccagcgcgtctaggtccttcttcagctgcagattctcctgacgcagctccaggatcttcatgttgttcttgaccaacccgcgacgcaccatctgatggaagtcgatacgggccgcgtcgtacgcc

SEQ ID NO: 109232 - DNA, 800 bp, Oryza sativa
attcctgcagcccgggttggcttgggacgagctgggacccagggtcgggtggccagttcggtctgaatcatcgtaggccttgggttaaggcaggttcgtgtgggttcacggccttgattaataatattgtatagctctggaatcgtgtttataaaatagctttgagcaactaagtgtcttttaatgctgtttactacaaaccctaaccctttatgttataacccccttgtactcccttgcatttgtcctgcacttgtgggtgtgtcttgttgagtacggtggttgtactcagtcttgctcaattttttcccaaacccagaagaggagcccctggaagatgaaggctttggtgtctagctcgtgcctgccgtcaagcgcctgtggtcgtcgccctagtcttccgctgtttcccgtttgtctttgtgtgtgctgggccttcgccgcccatgtaataattaactatttacgcttccgcttgttaaactctgaattgtatcaacttttggtgtaccttgcctcctgggacaaggaataatacacgcacgtaaggtgtcacgtcctgataaattcatcccgaaataaaaatcattttctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttaaaatgattttataaaaagaaaa

SEQ ID NO: 109233 - DNA, 668 bp, Oryza sativa
aaataacttcttgacctccgaaaattcacgggaaatttcaaaaagttttttagggccaaagaatattacaaaatattcccagccaacgatttttaaaggaaatttttaattccctctgtaattacttgattaaatttctctaacttttatttaatatctaggaaatggattattaaatgatttttaatcccgaacgaaaatcggggcgttacagttggtgcccgtcacagatgactgtcatctgtgacgggcttcttttagggcccgattgagatatggaaccctcatctcaatcgggcctcaactatggcccatcacagataagtgtcatccgtgacgggctttagttttatgccgatctaccatggctatgcgaccatatctcaatcgggcgaaacttcggctcgattgagattacttacttgtgacggcccgcaaattccagtcttgttaggggccgtcacagatggaaggatctgtactagtgggatttgaatttgagcctcctgacagcatcaacttcaaacgggaaccctaagcccttggccccggttttccccaaaagggaaaaaaggggggaaaaaattttttttttttccgcggggggtctatgatgacttgatggaaagctaatggagtctacttttatatgattttggtcacacgtc

SEQ ID NO: 109234 - DNA, 540 bp, Oryza sativa
gaacataatgaaacgttaacgaacgcgaaagaacgtgcacgaaacgttaacgaacgcgaacgaacatgcacgaaacgttaacgaacgcggacgaacgcgaacgaacgtgaacgatacgattacgaaacacgaacgaacttgcacgaaatgcttacgaacgtgaatgcacttgtactaaaagtgttagaacaaacgcgtttctacttatacgatttactggtaatacatatatgattatatatgtaatttggcccgtttagactaatacattttcctggtaatgttgcaaagaagacgtcggcgtcgtccctcaagccgaagtggtagctagccatcgaaggaattcgcgcaggcaagtgatgtaaataagtgattgttagagatttaatataagattgttagtcttcatatatataaatgattattacaattttaatatgagattagtagccatttaatataagattattagacttagcatatatatatatgactattacaattctaatataagattattagagattaaatataagattg

SEQ ID NO: 109235 - DNA, 1453 bp, Oryza sativa
cggcctatgcggcttccggattcacctaggcgcgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtatcttgtgggtacagttgtacacctctgatcagagtaaaactattcgaatagccatgcccgcggttatgggcggtcaaccagattcaccgtgattagtttcaccctagtgtaatcttttgaatttggatagtttaggtggatggttgggcctgttgcaacgtggaatagcgttggacagtggatagttaatattaattaattattacaactgtttaaatctttcaacttctgtttataagtgctcgctttatgcaaatgaaccactctagctcttctgtgataattccctgcatcatacccctattccggtatgacttgctgagtacagtggatagtactcagtcttgctctatttttcccaaccccagagtacgagtatgtgtcagatggaggtgtctctgaggagtaggcttcgtccgtgccgtcgaggatgcctgttgagtggtgttcccgctgcagttctagtcaaggcttagctcctgttgtctttcttttcttccgctgcatttatataagacttttatgatgtttgtaagacgtggatctgaatgtcaacattatcgtttgtgtaccccggccggtcctggacggggattttaatgcacatcctgcttggaattctattcgggaatttctgggcgtgacaagcgcgtgtgaagatggaaccgtaggcccgctagtctgctgctgtttatttttgattgtcaggccttaagtgcctttgtaataatgtaaatattatcgatataataaagatgtgtcttttatatcatgtttgtatggtgtaccccggcttttcctaggacggggattaatacactagcgttcgggaaagtgcaaattttctcggtcgcgacagtatcattattttaattttgatttatcccccctaaccaatcttaaattatacggtttggaaatatgtgaatagtaaaagtatatttccaaaccgaataatttgtaatggtatgatctaattaacccattttgtattggctttcgctttgtactttactgtagcaagccacaaccacgattgattgaaaagtggctcaaacaaacgagctcaatatctccaaccttttagatataataaataaattatgaaattaatggactggattttagtacttatatcaaccggagggatacttgtattaagctgggaaggaagttatcatattaaacttaataaaaataatttaaataatagatatcatttttctagtagctatataaaaatttgacaggttttgaaaaaaaaa

SEQ ID NO: 109236 - DNA, 1118 bp, Oryza sativa
tatgcattgtcctgcctccgtcctaaatcgggtgctgagcagatgaggaaaggcggtgacgggaggcagtgacctcctgattcctgagcctcactgcttccgctctttcccgcatcagcatgactcctagcaagtgatacatttcggcagagcgagtgagaggggcagcagcagcagcagcagcagggcctttctgcgccgtgctagggatgagtggtgagctactggattttgattcaacttagagtatttctcttttactgtttttttattcgaatttcctttttcagagttccagttgtttcttccacggttcaagattgtttgtgttttcccctagattgaattttcactgaaaaactttgaacgctggggaccaggagagaattcacgctctttcatggtggatcagagatgagaggaggagcatgtcatccatctactccatgccgtcccctctcacaatagatggagcatgtcttccatggctcgattgggaggacgagctctagaaatagattatgttcttatttctccactctgttaaatcgattcgttcagttttaatatcacaattgatctcctggcaatactatcgatcactttttatctctttttatccgctgagttgatttcactttctgtttcctctctcgcttgagcgaaggcgtaccgctacggacgaaggtggcaaaattatggattagcgatgcgatgtgcgctatgacagaatgcactatgatggacgaatcagagggtgacgattggaaaattacgaattttttaattagttaacaattaacagctcttccaccggtttaattttaaaaaatacctccaaatgattataagccagataaattcatattttatggataactttaattgtggattacatggctaaaattgtgaatcaaagttacaaccacattatttatagtggtgggtggtgtgtccgtcaatggctaggggtgtgtagtgatttcgtcgtgagatatgttggtctattggtctcaaggaagtactcataaggatatagtcggtataggggtgagtgtgcacgtatacaagtttatgtttcccttataaacgttagaaaaactttattatggtagggc

SEQ ID NO: 109237 - DNA, 550 bp, Oryza sativa
cctgcgccccccatgtaataaagaactattcacgcttccgcttgataaactctgaaatgtatcaacttttggtgtaccttgcctcctgggacaaggaataatgcacgcacgtaaggaacgcccgttgggttatttccagtcgtgacatgcattgtggacgaaacttttaccattatgtggtcgacggcgctatcgaccgatgttggattttccgccaactcagttgatgcgcaactgctgcgtttttaggtgggacttcctaactcttcatacgcagcagcagcggcggcctgggggttctgttgctcttcttggatctcttgcctaatcttggccctcattgactcgagcttttcgtcgaattcagatgtcagctcagctcttattgacgcccggatcttggcttcaaggcgtgcatctttctccgccttgttggaagtccgcttcttgtactgccacgcgtagtctggaaatccatacttctagggaacggaagacccaacgccccgtgtccgtccacgatgttccttgttgcccaacgctttcgtga

SEQ ID NO: 109238 - DNA, 675 bp, Oryza sativa
attttgggcgctgcctgtggaccgcccgtgctcttgggccacggcgccgcctaggccgcggtggacttggtccaccgtgtgccctccccttggagccgctgacgtgcggggcccgcgtgtcggcgccggcttcccctgctgacatcagcggcagcccttttcctttgtgaaaatatttaattaatgcgtcataaaccgataataattatagaaattcatttaatggctcaacaacttctaaaattcatatctaattcattcgaactccaaatagggcgattcaacttgcaaaattcatctaaaattgagctgtacatgtctgtttactttttatgtactgttttcttggtttttattagagtttttcctcgttttgcgtgctagagtgtagtttctgccgttttggaagtccgctgttgcgaggaaaggagtttagaagatcaaagtgaagaagtaaggcaagtcacacattccccttgagcattttgatcctactttacaaatgttttaccgtttggaaataaaattgcatgtcttgctaatacatgggatcagggtttacctatcttctcgcttgtgccatgtttacttgatatctatcctttgtcaacattgggtaataaattgactagctcatgttacttttgtgacctagctagaactatatgcttaacc

SEQ ID NO: 109239 - DNA, 905 bp, Oryza sativa
cctgtagaatttttcctctcctctcccctctctccgaactagtgcagaggagagagatgtgcaacttttttatttttattttatttttttgatttttttttcacacttaggaactcacaggaaccaaccatgtaaaaaataaattcaaacggacgaaatatgtggcatgtgaaattttccaaagctctaccgaaacacttctctcctcggaaacacaatcttgcaagtggaatttggaggttttaaatcggatgtaactttttctgtagatgtccgtgcatatattattttaatagatgacatattttgtccgtttcggtagagttttagaaaattctacaagtcacatattttatccgtttgagtttattttttatacggttggtttctatattctcctaagtgtgaaaaaatatcaaaaaaatgaaataaaaataaaaaatttgcatctctatgtactgtttaacttatatatatcatttcatgtggttatattttgaattagattaagtaatttcatatagtggtagagtgcattatgtttaacatgctgatcaaagggttttactaaaggagttatggtctaattttagtgaaggtgcaaagtagactaagtggtatgctagctattttcagacttagctaagtggtagttcgagtttaaattttttttgtggttagttgtatcatgatcctgagtgtgaaaaaacatctgaaaaaataaaataaaaatgacaccgttgcaactccatacagagaaacagaaatggaggcgggtggggggggcggcgcaagccatgctggcgccctcctccctggggcggcgccagcatggctggcgccctcctcctgccacgtcggttcgcgtgcgccatggtggcaggaggacggcgctagagaggctg

SEQ ID NO: 109240 - DNA, 660 bp, Oryza sativa
attcctgcagcccaaaataatgacatatcaatatatgaaattaataaacaacttaacaaatcggcccggcggcggcgcgcatgcggcagcggcgcaaagcaacgaccgacggcgatcgtccggcggcggagagcggcggctagcggctctaggaggagaggaaggggaaaaggagggaggggatgcctcaccgagggtggccggcgcggaggaaggcgatggcggacggcgacggcaagccacgggaggacggcgtcggctagcggacgagctccggcgtgccctaaggaaggagaagagagggattagagagagagagatggaccatggcgatcgggatccatggccgaaggcggcggtagaggtgacgctcacccgtgcacgtggggagggggttccggcgacgaacctcgacggaggaggggtggacgaggtggacctcggccgcgcgaagctaacggcggcgacggcgtgagacggcggcgagcctagcggcggctagcggcggccggagtagcaaaagcggcggcggcgggtggttgcacggcgcggaggcgttggggggctcgggagaggtcggcgcaatggggaaaaagcgagagggggtgccggcgatgcttaaataggggatgggggaaccggacgtggccgggagcggcg

SEQ ID NO: 109241 - DNA, 686 bp, Oryza sativa
aattcctgcagcccatactactctatactaagattttattttacagtaagtagaatatactaaacataagcttaatatacttagatgcgacaagatcttaacataaagggcagatttaacatgtcaatcaagcatatagaataaaagtagttgaatcagataagattggctgaaactccgatactaccctgataagcaaccagaaagcaggctagagattgcaattctaagcacgacttaatagatcaaactcaactgatgcagcattaagtatgaaaagaaaaacaatatctagacaatcaagccgttggaagtttcatagagtggtagatatatcacatagtctaagttaacatcattatctaacctaatcggctgccttccattaacagatgttagccgattataggttagacgaagatattatcaaagattatgtgagatatatgataactcgacgaattatatagacaagattagagtgtcataaagatggaagcactaatcttgagaacataagtcgtcatgacaagttttacctcttgttgaagattgaaaccgatgcagctcaacccgagagcacgaactcgtcgaaataaaagtaaagcataaagtgtggcgatgcgtcgagattgtattggatgtgttgttcttttttacatagggctcgggtctatttatacccg

SEQ ID NO: 109242 - DNA, 668 bp, Oryza sativa
gataccataagtctttacggcagacttttgcccaaacatatctctaaagaaattacatagaatatcctaattaatagatacaattgccttcccaggactctatccatgcgtggcaatcatcttgaagcacatcaacttgaacccgatgacgtacaccgagtcatattatcggaatcggctgtatcggctaatcggctgtatcggctagccccgtccgactcgaactctgtcgacctaaccttagccgatttggactgcagccgattcttactctgtttccgcaacgatcttcatcttggattccacttcgatctgatcttcatctccgatgccaataatgatagaatttacgaaatttggttgttaacaagtatgcagatttctgaccagatcgtacccaaggtatgatagagatctaacattcttatattcatgtccttgagacaaattgttgcaacgagtgaatcattttctgctctatggaaatttgctcaaatccttcttatttgtctctctgctgtgcatatatagctcatgttactgccttgcttccaagatattgggttcaaatataagataacactaataggtatctgttgttccaaccatgcataatctcaatctgtttaactaatgcagactctgtttgcttttataatggtcatttt

SEQ ID NO: 109243 - DNA, 521 bp, Oryza sativa
  unsure (1)..(521): unsure at all n locations
cgcagagggacctttaggctaaatgaacaccggctgtaatatgttatgcgaggcagatgatgaataaattcgtccaccgtgactagattatgaaaagtatgttgtatattgtattctcatgtatacgatcaaaacattaggttagcagatattataaatataggatcatttccttttcttcagtttgatagccacacgagggagcatggaggnnattattgcaaatgtgaagccacggtggattgccatgtcaggggtcgtagccagtcagtcgtgctttagtttttagccctatgtaccatgatatattaagtcaagattacggctccaaatatatgattcacaagattatggatctaagtggtaccacgacacaattaaaagagtactagctactctaggtttacactttattttataatacacttgtgaatagagcgagagagaaagagaggtactccctccgtttcacgatgtagttcattttagcatttcccacatttatattgatgttaatgaat

SEQ ID NO: 109244 - DNA, 771 bp, Oryza sativa
aaatagccacccgatcgatttgtgaagctttggaaagatgtacataaaggattcttcatgtgatgatgcatgcatcgagtataaccgggttcaatgttatatatgatttttgactttgtttgctattgttttgtttgtcttgttttggtttgttgtttaaattgacagagtttttattaatcggaaaattttcttcacgtgttgtaatacacaagtgtatttgcttgtaattataaaatatgtacttgtcaataaattgcgttgtctagctatctcgttttaaattaaaataaaaacataaatttttttgattttttaatcaagataacaagaggcaaatcaatagaaaattaaagaattgtcagagtaaaagtaaagactgcatagtatatacaaaatatatacaaaggctgaccaaacacttacaatttatacctacacaatggtcttgctaaccaccagcaccatcactattatcttttagacgtcggtagtatagatgaagacacgagagaactgtgacgcacgattgagaaacagactcaggagatagggcacatgcattggcgtcagaaaagctatgacggatctccatatttagtgtgctgtggctgtaatggatgcatatagtggagacatccatgacacacgatattgtacggccagcgaggagcttgttccccttctcatggctcagccgtagattccaggccaacgaagcctggtgcgcacctacaccatagtcgtagatgccacttgttcctcaacacc

SEQ ID NO: 109245 - DNA, 657 bp, Oryza sativa
agtgcacgtaggagccttttattcccctcgttccgaccaccaacttctgctgcaatacatgagcttgttggctcaactgcgaaggagctcgtccaggaggcctagccctgtagatccttacctcccaatccgccgccacagagctaaatctaaagaactgtggtctcacgtggtactgcagcctagagaccctgaagcacgaggcgttctggcccgttttatcggagatgttgtccatatacgagcatgtcctcatttacaacaaagtttcgtgcatggattggcatgataccacatatgtatcatattggtatatgtagtaccaccctggtgtcacacatgtaccacttggtatagaaaaatgctatgcgtacgatgttgctgtacgatttcaatacgatcaaacaccacaccatccctgtggaagtgaaaccaattttcatgtggaaccaaaacgtaacactgtcagtaacgctaggagagaatcttttgatcgtacaagtatagtaaacataagactgtacgtataacgttgctccttggtatatataattatgttcggtatcgtattaaatctactcctatttgtaccttactccatctaagaattggattcagcacacctattctatattacaaaaaatttcaaattactag

SEQ ID NO: 109246 - DNA, 562 bp, Oryza sativa
gggctacaacactcgaaggggacatacgtgcacacgaccggtgccggacatgaccacactggcgtgctcgtggcgcgaaaggcactgtgtacgggcgaacaagccacaccggaccacacatagcgcccgcatgtataagctagtaactacccaccatgattctcaacatgcatatgtgtaacacctgcagatagatatgctagctctattaatacaatcaaacagactcttgtatatatgtgaggaccatattggaaacatgcatatctgaaaaagctgacatcatccacatcctataagtagtgagcccatagaaggcctaaaactataataatcatacatctatgagggcggagaggctaatgtatatgaatataagaaattagaccgacttatgcatgaacatccctttgtcttctcttatacagaatcgcatgcctcgactaccgacataattactccccctgacactggggattatcaaagtactacctcacatttataatgaaggcaaaatttgatacgagacacccaaaaatcgtgtaattggctgtgagacacc

SEQ ID NO: 109247 - DNA, 916 bp, Oryza sativa
tttttttaactgacaaaatcatataaaaactcaataattagatagaggtcacatgatctaatttttaatttttaaataacaaaatatgggtcatatagatcttgaatttggtatttaattgataaataacaaacagttgaaaaaaataagaaaaaaatgtaacttgacaattgtgtagatttagataaccgattattatcatttttatatattaagtgttagctataaaataaaagaagttagctaaaaaataggagaataggggagagttcggagggtgtggaggggagtacttgtacgtgcgtgcgtacggtggtggggataccggatttttttcttttagatggagatttaattggcaaaattagtgggtccacctttttttttctaatttattagaacgccatgtggcggcttatgaaagtttgtaggaggccacatgacagcttgggagcgtttgtagatggttaatggatttttagtatataatagatagataatagatatagccaggcatatcttaactgaagttgcaactgaaaatcttactttatagtctaatttttaagaattattcgaatcaaactataacaacctgtttgtgccataattcaccttagagttagtttattttgggcaggacaaattatttagagtgtcgccttcatttcctggatatttgtgtttagccatttaatctggcagatttaccgtgcagtctcaacagcaaactactatacttgctcactgatgatcatgaaagctcagacatcaatgaatacatcacgatactgtgatggtgtatggaaatatcacggtataccattaaccaagatggcatgaaattatccttcgtttttttaataactaaccaagaagacaagaatattctgaccacactggacagccacgtagg

SEQ ID NO: 109248 - DNA, 1261 bp, Oryza sativa
agtttagaacttttgggtttgatatttacacacacattatttctaaaaaatgaataaaataaagtggataaaataggtattacccgctcatacccaattcttaaatcggtaaattcttcttacccataccctctccaaatattatgggtatgagtatgggtaaggttaatagatacctatagtggtagccctacctgaaagcgcagctaatttgtatacatgccaatgagtccaaagttccaaacgaattgcggccctctacatttccatttggaacctccaaattgcatgcatcgattcttcatcgcacaaaacacatgaatgacccccgatgaccgtcctgccatgatctgccacctagtgtggaagggcacgagcatatcatgcctatcagtcctttttgtctgtggcagagcacgaatgttggaggcactccaagcaaacaagacaccccaacattgtcgctagccagtgcatccaatcatccatggtccaggcagtaggcagctagtcaacctggttgtggaggagaccatggtatccacctcatcaacttcgccatcgagcaaaggagtaagaatataggattgataattgcgctgcataatcttggttcccagtgcctcctaaccctacacatgtaccacaggttcacttaaaaaccggctctcttgtctaagtgtattatggaaattgaatgcaatggattgccaaaatatgtgaagacctgaactatatatattcattgtaataaagattattatttgatatgatttgggatgcaagttcagaaacatggatataaattaatatgtattgaactacatgatatatatgcaatttatcagcggtggagccagggcccggcgaccctgggcagctgcccgggctccgccggctgcatgcaaccatacccccattagattaaacataattaccttgctaatcatctttctaatcatcttatgaattgaagcaaaaatcgtagtttaaaggctattgacaacacataaagtgccggaaggctggtttgatgtttttttcttgattagtatttctttgattttactattgatatattttttgatttatctttttctccatagtatatgacgtaggtaattaagttttttttttcagaaagtgcgatgatcgtacgaactatactatgcgtacgtacgttattcttttttggatggagattagcagcgtgggagttttaatagatctaatcgaacggtttaaaataacgggtccacca

SEQ ID NO: 109249 - DNA, 7618 bp, Oryza sativa
aaacaaaatactgtatttattttattttgtgttctagtaaaacatttaatatgttcttcaaagatttgagattgcgagcaataaatagaagtttgcccaataagcacaaactgacaatccgttgccccgctgcctccatcatcctttaggcctttttgggtttagaggggattgaagagaattggaagggattgagggagaataattccacaccacaataggaattaaccaaacaaagccttaggggttgttcgtttaagcaccaagagagagaggggttagaggggactgagggagaataattccacactccaatagatgtgggatagcctccatcggtgttagtagtttcttttgttaaaaaaaatagtaatttgctttacctgtctatgaaagaaagcctagaacaggaacaaagtcttctacaagaaaggaaaacgacaacgattctacagagaactactgacaacgaaacagaagctaccatggttttccagcaccagtacagagcttcgcaacattccgaacaaaaagataagcggcgtacttcattccataactttcttttctttttttgccaaaacaaaaactgcacatgaaccgccgcaccctgaccgcatagacatggttgctgtgctctgcaattccgagcaccattccgtgatccatggccttctgactttgcagagaaagatttacaaacaaggaagagcatcgtacgtctttgttcccgaatgcatcctaaccctaacgcgcaatggtgatcaggttgatttgtgcctgaagttagatgattatcattgcacttagaaactgaattaattagctgaatataagacgaactggtggcaaggcgttgtgcgtgtgtggatggataaatggacgcaatggccttttatacgtactccctccgttccaaaaaacaaatcatggggttccgtgtccaacatttaaccgtccgtcttatttgaaaaagatataaaaaaattaaaaagataggtcacgcataaagtattaatcatgttttatcatctaacaacaatgaaaatactaattataaaaaaatttcatataagacagacagtcaaacgttaaacacgaaaacctagggtttgtcttttttttttcacacggagagagtactcggtatatgctaccacagtcatgacaacatgttgcaattaagtcattggtgcagagaggggttaactccaagcttccgataagtattttctttggataaatgtgtggtatcttttcaaagggataaggacggcaaaatggtcaaaataatggagaaattggtaaatggcaggaattagtacgttcatgcaccatggagcaattatacggtaataaggtgaagccaaaaatgtcggtggtatagaactaaacatcctgtactttttacggtatctattgaaccgtatttttttaattccaatgaactaacatgacttgcaagcaaaaaccatttaacctttgaggttttcttccatatttgaagaggtatatacctactcacaatttcagatttaaacaattaaactggttaaacttattaggaaacaagtttctgacattactaaagctccgttcgttacctccctttcccaacctctctccctcgttttccgcacgcatgtttttttaaactgctaaacggtactttttttgcaaaaagtttctatacgaaagttgcttaaaaaatcatattaatcaatttttgaaaaaaaagcaaatacttaattaatcctataataataggtgctttgttttgcgtgccctcccgaacacagccttaaaaaaggcacatagaggtcagcgttgtacgcgcgagaagtgataaaaccaacacctataatccatttcccacctctgcagattaaaaacacaaaaaagaagcatctttaagagactataagtgccggttctataagaaaaccgacacctataataccttttttcttaaaaataacaagcacatttaatttatcatagatgacagttatttaaaaaccgatacctataatattgtgtaggtgtcaacactacactaaaaaaaggagtcgagccgaccggtggtctcgagtggataaggctgagagggctcaatcctctctctctatctctcgttctctctctcgtaagttctctctctatctctacctagtggcggcggcagtggcagctctgttccctctagtgggaagggaggcgatgggtggcgccaggaccctccccatcaggagtaggtggcaggtggcagcgcccgaggggaggaggcggcagcgtggcagtggtgtcgagcggcggtggtgtcgaccagaggctctttatgttaattatctatctgttcttgatgtgtattttgtgattgtattcttatggctgggaagaatgttcttgatgttcttccatgcattcggggcgaggtgaaggggagttgctcgatgtattggcttgatcgagccgatgaatcgagccgcctttttttttattctaaggtgctggttttgcaactgatacttttggttttcctcatatgtgccggttctaggtgccggttgagaaatccggcacctatccagggttccgtgatagtttgattagcaggggcaagactttttctctcgttgcaaggtatagagaggtatatataactctccgtgttaatccagagtatatacctctagcaaggtatatacattataattggcacatatatgtataactctaaaaaatataagaaaatgtgacaagtatttataaagattaattttgataccacgttttatggtgggtaaaaggagatgtatatatatcatgtatggagagatacatattcctctccaccaagcatgagagaaaatctcttaagcctttttacctcttcaacatttttttactacaggatagcatatcagtcccctacactccagccattttattcagactactgcaatacgtccacgtacactagtggagaaacgatttttactcccggttggaaaccccctaaaatataatcctagttttccaaccgggagtaagaatccagggctaaaaatcgctatctttagtcccggttcaaatactcgggactaaatataccaatcgggattaaagatgtggtcccagttggagggtttttttcttctctctttctttttcactgttcttttgctatttgcccaaatcatctcatatcaaacattcacagcattatctcagatcaaacattcacaacaaatcattcacagcacacagcaatataattcatccaaatcattcacagcaatagtttatcccaaatcgttcacacaatagttcatcacatatcgtatcaatcaacacagatcgaatcgcatattaagtaaaaaagataaaaaagataaaaaaaatacatggcagcgccggcctccaccgcctgccgccgcaccggcgccgcccagcagcctcccctccggatccgcctccgcctcaccgccgccgccgcccgactggccaccgcggcgcgaggccgccttcgcctccgcccggccgccgccgccgcccggccgctgacaatggggaatagaggggaggaacagaatggggagacgaggaggaggaagaggaagagatgggaggcggaagagataatgttagggaggaggagatagaatttatcaactcctcgattacactcacgcctcgtcctctccaccgcgcatgccgatcttttgttccggtttaggttaccaaccgggactagacatctatttctagtcccggttggtaatagggatctttttttccggttggtgtgttaccaattgggactagaaatagaactttaatcccggttgaaaatgccaaccgggactaaacataaaaaaaagtagctctaaccttttgaaccaggactaaagataatctttagtcccggttttttattgcaaccggaactatggttgaatttggctgaccgaccaaaaatggtttctccacaggtggtatcaaccgatccaatatataagccagaaagcaacacatccatcggaccttccaaattctgtttttcactttttttagaaatctacaaaactctacaatgtgtggtgagctcaatctgtgttagaagtgcgagccagagaaaaagaaatgtacttttcagatcaaagatcatcacaatatactgcagctttaacttataacaaagcttgcaagaaaaacatgataattcattgaatttgtcacatatgatcggtcgaatttgtcttgatgtcctttctcttgcttcaaatacgttgcaatatcaagtcatcacgaacaaaatctatatattatatactaaaaagtccatcaaactttctataaacgctcttaaatcgctacgtggcactcctacaaacacttctaagtcgctacatggcactatctaattttaccgttgattttcgcttaaattggtgacccgatattatagaccattagattagatctattattaaaaaataataacttcctcgtgtttataacaaacatagagttaatatataggttttgttttattattttactatacatctaagtcatctacgtatattcatgggtaaatataggaaataataatccatattactactgtccgtacgtgtacgtacgagttcgtacgatacaaatactattgctgttctttctgtacttacgaatatacatgaatgaaaacaaaacaataaacctttcctaatcttcgttggaagaaaaaaaacatacgcatgttcataaaaaagacggtaaaaacatacatccataaaaatcaacggtctttaaaatattttctataatatatatataaagataaaatatattacttcataaatataaatatatgtagttaaactaaaatctataataaatgtccaatcaatgttattttaaccatcttctaaatatactaaaattatattaaactttgtagaaacacttttacaccactacgtgctctcaaataaattagagaaatccgagaaatctattatatactaaaagtctattaaatatgctgcgaatactctagcattgtcacgtggcactctaataaaattagagaaatcctagaaatttagagtaaaaaaaataaaagcattcaaccttcaattttcacttaaattagttagtagacccgttattttaaacattgcattagacctcttaaaaatcccatgttgctaatctctatccagggaaaaaaaacatagcgtgcttatgttgtacgatcgtctccctcccaaaaagcacaaaacataaatacctacatcatatacgatcgaaaaaagataaagccaaaaaataaaaagaaaacatgcacacgtacatagtagaatcagaaagaaatactaatcaggaaaaatcatcagtgcggtcactgatttgttatcaatagcctttaatctacgattttattaaaaataatactacacatatgtgcaaagttaaacttaatcataaacttattgtagtgataaatatatcatgacgaatgacaccaacatgtaatagttaatgcgaaaataatgtttcaaataatttcatatcatattttatggtgtcaaatatcacttgacaaaatatacaacgttaatttgaacctacatatgtaaaaattaaaataacaaaacctagcattgttgtttaagtacatctgtttaggtttatttaattttgggagagactcgatcggattctcaaagtatttggaatttttcaaaacttttcttatttgaggtgtgggaagcacaattaatagatagttgagaaaaaataaattaaattttagccagtgataataaaacaacagaatttaaatttggtttttaagtggatatttttaggtatattttgggtgaaattgagattattaaagtatctgaattttttcaaaacttttttttctatttgaggagtgagaagcataaatgatagatagatgtgagaaataaataataaataagattttagacaattattttgctacaatacaacccttaattcatcacgtgaattatgtattttttttgccatgtagtattggcaaaacatgaataatccaataaaatacgcgtaaaactacttatgttttattttttatagatgatagaaattttaatatattgggtacaattgatggatgaatgttagacaccattgaaccgaactgtacgtgcactctagcgaattagttagtgtaaataagtttgtgaaaataagtacattcttagaatttgtaaatgagtctcgtatagttataaacaacatatggtggaaacaaatctgacgctaaagtataatctctatcaaaatataaataacgatatggtgttttgcagattttcatggcggtacgtctctttagctatagtttttgttagagtagtgtcgaatgattaaccctgctcatttgaaaaacataatatttatgtattccattaaaatttgagaagtacctattagtaactttatatacacattttttctattctctatcacaaatcgacccaaaacttaaaaaaaaaatgttttcatcacttcctcctttttttctatccctctttgtccttgaatgcaaggcacagtacttgctatgccatcgtaaatattgcatggggtatgtacatggttgagttaaggtgttatccgtgaaaggccgccataggcaatgtaactaaagtaacatacttacaaatataatcatttgtgagtgtacggatagtgaactaagtgttaaaattgtactctaggatggttttttggggcatggctacatcaatgtgggacctatatgtttcaaggcattatatatatacaaaagcattggttagcagatacagtcgactttatatagactttatccgttagagaggcattcgtgtttatttttaacggtatatttagactatttatacatagaagtgaaaataactgatgaacaccgggttatacagtgtagatgaatttttttagtgtattaataatgtatcatttattttagtggtactaatacagtttcatttattaagagtgcacctaactcttaaaacaacgatagtaagtagtgatgaaaaacaactagtttatatatgactaggacaaagggatttttatttaaatatgagagacattcttattacattagtggtatattaaaatctaccgtctatcttacggtaaatatatttctttttttattgtaggataatctaaattcccttgtagtgtatatatatatatatatatatatatatatatatatgataatggaatataatcccagcctttactcaaatagctacagccaattattacaccaactcaacaaaaactcacacctaaataaacaaaagcacagacaatctaataaaaactcacacagcataaaaagatcacaaaaattattaaattctatttgtgaatctccatccaaagttagcgaacagctgcataaccaatgactcaagattacgacatgcagctttcactgacttgatttcttcatcacactttagtagctgagcctagaactggagccagtatgtggccctaaaaagaacctgcatataggacatagatggtg

SEQ ID NO: 109250 - DNA, 1291 bp, Oryza sativa
gaccacaccggaaagcaactcaatcactgcacctaacaacacatttggtgcacccaaagcaacatgtatcattataaagtgcttttaacgtaaatatcgtactccctccatttcacaatgtaagtcattttagcatttttcacaattatattgatagtatctatatagatttattaacatcaatataattgtggaaaatgctagaatgacttacattgtgaaacggagggagtagtaagtagaggaactaaaaatgtatgtaaacaataaaaatgagtcaaaccaagtaataactccacttaaggtgattctaatattgaaatcgtctcaggtacaactctgtcataattttatcataatttaggctatttactaacaacctaaacatatatatatctattaaattcatccctactaaatgttaatgctaattctctcttctctcgtaaagccatatcatctcaattgattttgtctttgaatgattcattaggggtacaaattacacccttttctccccaaaagcctcctcatacaacacactcatttgtatcctttggataatttatcaaggtacaacatatataagcacataaaagaaaaaaatgtataataataaagtaagaaataaaattttacaactcatatatactattttattagaaaaatcatacaatatttgaaaaagtaccttgaggtatatatctaaactttacgctaaaatttttgctaacttaggtaattagtacctgaaggtaccaaactttacactggaaaatatggtacctccagatatccttttaaggatgataaaattatatattttattacacaattctcccgtagtaatgcgcgggtatccatctagtttacttaacaaaagaatatttccacatcttgggtggaaatcattagaagacggcatatgtcacaacccaaactgttaagtacagtaattaaccattaatccttcctatgtaagttaattaagccttgataatcctaatgattaaatatgtttatcagaccttaatccaattatcgtagctcctaattacaatatttaaccgttaatctggttttaagtatagtgattaagtgctatatatgcacgtgctaacgctacggcggtaattgatggcttgttatgttggcttaacgaaataaataattgaaactgaactcttacaagggaaatacgcttgtaatagtacgtctgtttgtgtcacagtaccattactaagaaaaccggattggtgccggttgggaagcccacttaatgccggatttg

SEQ ID NO: 109251 - DNA, 598 bp, Oryza sativa
gccgcctcacgccctcacagcggccgccgcgcgcacgtcctcgccctcgccgcggccgccgctgccaccagcccgccctcgccacggccgctgccgccgcgcacgccctcgccaccgcccgccctcgagtccccgattcacgcacgcacgagttggggcctgggaggactcagtccttatccattcccttaggggtacaaacgtaaattcatataacctttttttatttccttttgtattttttaacacaaaacgtgggacccaccaaacgactgttataagtgggggtagacggctggttcagattcaaaaagtgggggtaaaactgcaaactctaaaaagtgagggtaaaacagcaattggatttgaaagtgggggcctggatgcaattatccctttaatatattgatttcactccatcccgtccccaaaatcccaaatcaatcgtccccgaattatctccaaatcctcaaatcgatcatctcaaatacatcacaaaatctttaaaaaattacatcacaacttctacaaaattcatcacagattcacataatgcacaaatccaatacataacacacaaatctatatccgaatcaca

SEQ ID NO: 109252 - DNA, 657 bp, Oryza sativa
ccaaaataccactagcatatgtttaaaccctaaccacagatctaacaaccctatcacaaatcgattctctagtgcccacatgctatcccttatcagcagtgggtatggctgctaaacaatctccaattgcgggagcgttgacggtaagatttccgcataaaggatggcgggtgcggcagctaccatgggcgttctgatggtatccacatgctccacatggatcgtgacggcgaaacctgccattgctaccaatggaggggatgggcaccagcatgactggaacgttcattcatcgtgtatatgatccgtcatcaccagctccatccgctactgaggatgcgctcggcgaagacagatccagtggcacagagggagaacatttgcagggtggcaccgatcaccaatgctaagtactgtggctgccggaggtcatgaacaacaaccacaatgttccatcggcctttttattatgccctacattcgttcttaatatggatggatatttgaatacacaaagtgcaatcattacgaacacaagtaatgcataacaatttgatactttagatgtgaaatgttgattaaagctaaagcatcaaattgtgaagttgatatgagaaaagtcatgttgttgcccaaagcttgatatgtgaagggcat

SEQ ID NO: 109253 - DNA, 1603 bp, Oryza sativa
acatcaaatcatcaacggcagagatccgactgttttcacaaaaaaacatgcgacacagatatagctcatccgaaaaaaagaaaagagcagcaaatccacgcatgaatcatgtcctttttttttaacagcaaaaacgcatgatgctcgtacttgacatgcggcttgcctttgttcccgcgcgttggttcgcacgctagaactgatatactctctctcaaaatactacacacacagagactttagatttgtttggtagacttttaatttctaaatttaactttagaagttaggtttaaagtggagttacaaaacagattaaacctagcttcatctctctagtttattttgtgagagctttccacacagctttatttttattttcggtggagctaaaactatttggttgggtttcagctgaagctaaaccggtgtgaaacatgctctttacaagtgcttcgaatcatcagggttgtgcggaggtgctcgattccgctttgcatgacacactgatgccatctccatccatggcctcctgcagaacgaaccgcacgcgcacggccggcaccctcatcttccggcccattttggcgtgttttccctttgcattctgagcgtttccttcgcctccccgtgcctctcaattcaaaacttcttttttatcgattgctcagattgattctgttccccaaagctagcgcttatcaaaatcgaatgggactgacaccatcatccacttgcccgtcacgtgaacgatctgaagtactactcatccatacacgctgatcgctaattaaacaggaccaaagcgagcactttttgccttaaaccccgtagaacacaccgccgtcacatgaacccaaccggacattgcctccaaacccctggaataataatacccgaccatacggctatcccgttctccacagtttagtttttgttaccacgttattcaaactgttaaacggtattgtcgatacgaaaacattttatatagaaacttttctaaatactaaatgaacttactttttaaatttaaaataaataaaacttaattaatcatgtgctaataactttttttttcattttaagtattactacgcacttaatttttgtccgctggattctcgaatgcggtcaaagtgcaacgacgacgtgaccacccgaggtcagatatttattagctgcagcgatcgaactcgccgtctcacctgcgacgcagtcaaatcgatcgccattgctgcagcttggcagcttctgtagatagatattacacgttgccaatgacgaagaagaagcttcaggtcgtcaggcccagagcggtgtcgccgctcccggcgctcgccgccgccgccgccgtcgccgtcgtcctcctcctcctcacggcggcgggacgcccttctttcctcggaagatacgaggctatcaccatcagcggcgtcgcgtcgctgccgttcggttactcctcggagagcgcgcggcgcgcaccaccggccgtcgccgtggcgcgggtgccgagcgactgcgacatcttccgcggcgagtgggtgcccgacgacggcggcggcgcggcgccgtactacacgaacgagagctgcccgttgat

SEQ ID NO: 109254 - DNA, 824 bp, Oryza sativa
gttttgtttaaatttcaaattttagttatttgtaaattatatttttatacggactctaaactctcttttaattttattatatttattccaaattttagttagttttaaatttctatatggactctatactctacgtctaatattccttatttttaattccaaatttctattatttcttaattgtatttctatatggactctatactcttctttcaatattctttattttttaatttcgaattcagttatttataaattatatttctatatggattctagtctactcttccaatattccttattttttaattctgaatttctattatttcttaattgtatttctatatggactctatactcttcttctaatattatttattttttaatttcgaatttcagttatttataaattgtatttctatatggactctagtcttctcttccaatattccttatttttaattccgaacttcaactctttctaaattgtactattttcatatggactctagtcttctcttccaatattccttattttttaattccgaatttcaactctttctaaattgtatttatatatgaactctagtctcctcttctaatattccttattttttcaattccgaattttagctatttctaaattgtatttctatatgaactctgccttttctttttctccgattaatgtgagaatttctagatcatgagagcgaacgtggagactcatttttctattcctttaataatataatagattacatatgtaattttaaaacttacatatgtaattttcggatttacatatgtaattttgggactta

SEQ ID NO: 109255 - DNA, 659 bp, Oryza sativa
cgacacataggacgttccggtggatagcttagacgacgtcggtgtcaagcacgtcgactaaccgcgccattaaggtaggctggcgggcgcgacacagtggactgccgatggagattactgggcgaatttaagaccttgataactttgccttccgggcatggaatcgagctagctttttttgacggctgcagaatcacgggcctcaccctagagaggctggattgggagaggtgggcccccagaggtttttctagaaaccacttaccataggccacgaagcagcggttgtttcggcaaaatgtcgaagatctgagggtccacaactggttttcaacgaggtggttaggataggaatgacacataggacattatggtggatatatagcttagacgatgtcggtgtcaagcacgtcgcctgaccgcgccgttaaggtaggctggcgggcgcgacaccatggactgccgatggtgatttctgggtgaatttaagactttgataactttgccttccgggcatggaatcgagcttggtttattttgacggctacagaatcacgggcctcaccctagaaaaagtggattgggagaggtggaccccagagatttttctagaaaccacttacaataggtcacgaagcagcggttgggctgcaggaatt

SEQ ID NO: 109256 - DNA, 712 bp, Oryza sativa
ctattagtactagtacaaagaaaaactagatcggtactccgtgcgttgctgcgggagaattgtatgataatataagagatatgagttataaaattttctttattacctactatacgatttttatgtgtttatgcgtatatatatttttgtacctttatcaattatctaaaggttataaatgattgggttgtatggtgtgtctttgggggaagagatgcaatttctacccttgatggatcatccaaaaagatgaatctaaaaacaattgaggtgatatgattttatgagagaagagagaattaacattaactacacttaggctgtgtttagttccatactaaaattgaaagtttgaagaaattggaacgatgtgacggaaaagttgaaagtttgtgtgcaggaaagttcgatgcgacggaaaagttagaagtttgaagaaaaaagttggaatctagaccgtgccttagtgggccgtggacagggctgaaatgaactatgggcttgggtctggacggttgagaaaggcacaagaggagaggagaccaaaaaggaagaggggggaggacccattggattcgccatggcgtcgtcgccgcaccaagttgtagctccccaaccccaatcccaagcccaagcaggtggcggcggcggcggcggtggcgggacggccgagcagttctggtcgctgctggacaaggcagaccggcgcttc

SEQ ID NO: 109257 - DNA, 707 bp, Oryza sativa
aagatctgagggtccacaactggttttcaacgaggtggttaggataggaacggcacataggacgttagggtggatagcttagacgatgtcggtgtcaagcacgtcgcctaaccgcgccgttaaggtaggctggcgggcgcgacaccgtgtactaccgatggagatttctgggtgaattaaagacctcgataactttgcctttcgggcttggaatcgagctaggtttttttttacggctgcagaatcatgggtctcaccctagagagacttgattgggagagatggacccccagagatttttctagaaaccacttaccataggccacgaagcagcggttgttttggcgaaatgtcgaagatctgagggtccacaactggtttttaacgaggtggttaggataggaacgacaacgacacataggacgttacggtggatagcttagacgacgtcggtgtcaagcacgtcgactaaccgcgccattaaggtaggctggcgggcgcgacacagtggactgccgatggagattactgggcgaatttaagaccttgataactttgccttccgggcatggaatcgagctagctttttttgacggctgcagaatcacgggcctcaccctagagaggctggattgggagaggtgggcccccagaggtttttctagaaaccacttaccataggccacgaagcagcggttgtttcggca

SEQ ID NO: 109258 - DNA, 1133 bp, Oryza sativa
gcaaaacagagcccgggcctcaccaggcccacctcacaccacgtggtgtgtgaggtggaggatagtccaaccacttctgactgaggacttgaagggtttcttgaggagcacgaccgaggagtcagatggcataagacaagatattcgatgtgacatattcaagggtagttaggtaatattgtgagcacctccttgtgctataaaaggaggggactagccccgttaaaggggtctttggtcggttaatttctcaaggccttagacatcgcctcatattgcttgtaactcctcccttagggaaaagagtcggtctcgtacttcgtcagctggacttccatccggtcgccgacctaggggagttagtgaaagccagaacacaggagtagggtattacacctcgcggtggcctgaacctgtataaacatcttcatcctcctgccgcgggctctcttgcgtactcactcgcctccatcctcgcgacttccttcatgccatctcggcacgaccaccgtccaggtgctgacaaacccgctggacgaatctccattctcacggggaggggttctcactcctgtgggttagcccctatgacacatgccgccaactacgtccctcctacctgccgatctcccgatgcttctaaaccctacatcgatatacctccatatcccttcgagcaaatttattccttatttatcactcaaagtccacatgttttcttatatgtcattaaaaattttctattcggtatttgccatttggtggaattttacatccgtttctatgccattgccattacgcgagtttgaaagtgagcttggattttgctattcccgtgtttactgtgagcatactttctaaactattaaatggtgtgttttttaaatactttttatataaaagttttttaaaaaaaatcaaacagacccatttttaagtttgtaataactaatattaaattattcatgcattaataactcatcttgttttactctacatgacattaataataatccaagacaactcgccgttaatgtctttgcgttgtaatgggattagaaagaacatgtgaagctccctctttactgtaaaaaaaataatatgatagaatgtttttgtacggtttagttttt

SEQ ID NO: 109259 - DNA, 776 bp, Oryza sativa
cattgcacttagagcatcacccagagattacgtataatctccctccaaaaattagtttttggttttcctaaactgaaataggtagctaaaaaactgatctctcaaagagaaaacctaaattttatccccaaaattaaaagtgggcctctactaaactatcaacacattctcccatgttcctctctctcgtgcgcatgtggaaggagtggcactacctcctagcgcgagattggggatggatgagggtgtcggtttttaccttttcccgtatatcaacatagcatatttttcggggaagggactccaaaaaacatgcaagggagtagaggatctgttagagtgttttttccactaaaatcccttaaattagttttaggataaaatagaagtacgttggtgatgctcttattaaagagcgcaaaataggaaggaacccaaatccctttccctagcccccaatcatgggtctctacactagcccccatctattttttttggcacgggtgaaaaatctctagcatgcacttctcctgtcgttttcacgccctcacacaccgccactgcccttctcctttgtcgcactgtcggacatcgtctgaccatcttaccgttcatgtttgtagaatatgttgtttttaagttatataatgcttgtgaactagcatatgtgtgtgattgtggaaattgaattttattatgcattttgcaatgttgaaaaaattgaatttaaatttaaaccgtgatctttaaaattgtaaatttgaatatggttgaat

SEQ ID NO: 109260 - DNA, 3645 bp, Oryza sativa
gtatgagagatactaaacacaatgttgacatatttaggaatgattgggattttaccttttggtagttctataatgtcagttaacacattatagtgttgtagaaaccatattcgaagctacttgaaaatacttgatcacttaatgtttaataagcctccgaatcctaatattttaaccttttctttctggtcaggattgaggtcttttatgtttgcattgaagtcacccggactgcattttgagcccaccctatgctgcagaaatgctatctttcatcacacatgacaaggatttaaagtataaattgtactatactatgttactcctcatactatggcatacagtgagggggcagaaattgatgtattgcaaatggatgtctattggctagggtattttgcttactcagtgacatcagatcaaatgaatgcaagatagttcctaatagtgacccattatccactggtttccttatagcagttttataagcatgaaatcaataggaaatgataacaaatacatatattgacttaaaacataccgttatgataggagagccggcataatcccctttttgtctcttcttcttgggtgatttggacccagaagttgaattctttttaccttttttggtttttttttggggggagggcagtaggttatggggatcgcatagttttcttccctttcgaagtgtgcacactgatatgtagatcactttgcaggttaaccgaaaatagtcacaaaaaatgaggtcagctagccaaattcagtattggacaacatcagaaaacaactacttcatagtacactgttcaatttctagattttttaatgaaaatttgtggattacaactccaaaacattgccaaaattgaatcagttgtagttttattagctagtacatggacctgaatccaataggcaaacacaatcaatgttagcaaaaatgtatgttattaactaacatttgcctagtgatatatgtcgcaggtactcaaaatatgtattattgtcattttcgtcatccatgtcagcctcattttcatcaccagccctcccagcttcagtagtaaccggttcacatgagaccaacgaagaagatggaggtgtgaacatatgacctttcagttgattagaagcacatgactgacttgctgtcgcagattcgcttgccacacctgggtctggcaatgagccggcgagcaccatcgatctggtcatcggtgccatagacatcctggagaagaggaagatggcagcccgtcgtctgtcccataaaaaaccaacctagtaccggatgtgatatatcttagtactgcgaatgtggacatatatatgtccagattattagtactaggatatgtcacatctagtcctagattcattttttatgggacggagggagtatatatctcaaatttcgatagtgttgagtgctagtaccgacaaaggccactgatgaaaggagggggaatgagacggaggagcatatatacgtaaaacgaggtgaacctttaacaaaggatcacttgagtttaaattcttcaaacctgaaaaatggattattaggatttgttaaagcaaccacattcaacatttgtcgaagcgcgaaaaacaagtgctctacatcagaaccaaagcagcctaatttgacaattttagtaatgctcaagtgctctacatccaacttttcttcttgctaggtatttctaactctatacatccataggaatgagtgtgctctgcagtattgatctccgacgtggattactgacgtataggtgatatgtgcatgtgtgcattaataggagtatagcgcgcagtggtgtgtgtggatgctgaaaagtactacatatttaattaacttgataaagacgatattcatgtaataatgtaatatagtaatggaatagatagaaagtaatgtcgaaaattaactaacttatttttgtagtaaatgttttgtgcaaattattgattaacatgattttactaaatgtcttagggaatttaataactttttattttgtattgtgtcacgtcgaaaaaccacctcctgattgcatgccagtttattgggtagaaatgaaaccacctcttgatagcacatcggtttatgggcagataagcgtgtgcatgcatacaacagattgcattccgttgaagaatgccaccaattatggcaacttccgctccacgggccaaatatctagagccatttgttcgcctttaaatttgcctcgcgttagacctgtagattcatttcacaacccaaacgatacacgtcaaggcgtcaacaatgaagccttcctccggcgactcgaatggtggcacctcctccaagcgatagcagacaaatgtggcgagccaacaaaatggagaatcactagatggttttattgaagatgaggtaatcttgcaatgaaccatggcaacattgttcttgttgtgaattctgtgcatgtttctcccgatttacttaattttgtgagtcattgaaatgaatttgtgcttatttacataattcttgtcatgaatcacatgcatgtttctcccgatttacttaattttgtgagtcattatatgtgtttgcgttgatttacattattcttgtcgtgaatcacatgcatgtttctcctgatttacttaattttgtgagtctttaaatgtctttgtgttgatttacataattcttttcgtgaaccacatgcatgtttctcctaatttacttaattttgtgagtcattcgaatgtgtttgtgttgatttacataattcttgttgtgagtcacatgcatgtttctcctgatttattaattttgttactcactgaaatgtgtttgatttacataattatgtgagttattgaaatatttttttccttccgacatctattttagatccttgctacgcggaatggtgcaatgacggttgtgtgctcccctagcagatttgtccaagcagttcaaagtttatcactagaccatcttagggagatacgatcattaggttttggcggcttattacacatgaaaaaaatcagttcttcctcgaattatgttgattaaggttgctaaaggattcaacatggaaaataatagttttttcatagagggaaagtgcatcccagtgaacctatcatatgtggagaacattatgggtctacccatctttggagaaaaaatagaagtacgcagagacggtcctatcagcaatgatttgctacatgcatatgaaacactaggagagaattgtgtaactttcaaaagtctagagactagcatcttatcctcgaaggttccagatgaccacttcaaatgacagtttgtgttatttacaataggacgactgttggcaccagcaacatattaccatgttaatgcaatgtacttggcactggttgaggatgtggaaaagatttccaaatataactggggagaattcacaatgcgtcatttattggactgcatttctactttaaaagaccatgtaaatctttagggtaatcttgcccttctgtaggtatataagtatactatccaagtgtgatcaactcaattgcaaatttgcatactaaatatttgcttaatctcactctttttcttggtttgtgcttagtccttacaattccttatttatattt

SEQ ID NO: 109261 - DNA, 655 bp, Oryza sativa
aaggttgtgtctgagccgttttttccttttgaggaatcttgacttgaaataatgtcactcgtgctcaaccccaccctcgggggctcggtcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactggccccgacccgagccattcgaggactgggacttgggcacgagcccttatttcaagctaaggcgcaaaaggaccatggcacagatcatcctcatcgcatatgtatagcaaaataaaactaacacaaaaattttttcatcatttcgtttctgattgcagattgagttaatttatacaaaaaagaggcatgaaggccttagaagaaagaaaaagaaaaaaagtaaagattggcgggggctcgggggctcattccgatgcgcccgggtagccggcctcgtcgccaccgtcatcctcaccgctggcgtcgccctcctcgtcggagctggagacgaacgcgagccgaggggccgacccctcgaagccgttgacgatgtggtcgggagcattcccgacccgcgcgcgc

SEQ ID NO: 109262 - DNA, 742 bp, Oryza sativa
cctaatgggcaaccgagctctgataccaactgatgagggatgttaggtcccgatcttccgataggtattgataaacagtcgatttgggcggagtcgcgacacaactcgatccggcttctgaacgaacacgctactgagccccgcaattgtagcaccacgtctcctctggttatcaaccgtgccgaaacccggttgacctcgccgagaaggctaatccctgcatgcgaatcgaagaacacaagcaagaacaagatagattgccaccaaattgcatatgaatgattaagcacacgaatttggggttccacaaaccgatctagcggcgaaactgttcttgacagattaatttaagctaaacccgactctaaacgatgacggctactgaataaatgtgattagggacgtcctagggttgccctagggcgcacatagggatggcaacagggctgcacccgccgggtttcattaccccgtccccgcccccgagttgatggaaatcccccgttcccagtccccatcccgtgctcggggaaggtttcctcccgtccccgtctccgcatcgggtacggggcacccgcgggttctcgcacccgaccacaaacatcaaaatacatagagcaattgaatatgaacatatgataaagagttcacagttcacaccaaagaaatgaagcaagagtaaagaacttcaaaattcaatgtagatgtgcattaaaaacataaacttgatgcactagtgatt

SEQ ID NO: 109263 - DNA, 1247 bp, Oryza sativa
gacttttctagtatatgaaaatgttgtttgaagttgtcatattttcaaattcaaattcaaactgttcaaaaaaacgttatatagaaaaatgaccaaaataaaagttatagatctcgatgagttatacaactttgttgttgatgacttttttagttcaaatcatttagtatttgaaaatattgttttgaagttgtcatattttcaaattcaaattcaaactattcaaaaaaatgttatatagaaaaataaccaaaataaaaataaaagttataaatattggtatgttatacaactttgttgttgataatttttttatttgaaattatttagtatttaaaaatattgtttgaaattgtcatattttcaaattcaaactcaaactgttaaaaaaagttatatagaaaatgacctaagtaaaagttatctctaacgggcatcaacaaaagctcgacaccgatatgagtcatcggtgacggttttaaagtcatctcaatcgggccatatttggagcccgtcaccgatgaccctcgtctctgacgggctcggtgtctaggcccgattgagatatgcgaggtcatctcaatcgggcctaaatctttgcccgtcacagatgagtgttatcagtgacgggctatatgtacttgggcctaaagtgagtacatctacaacggtgcaaatttaagcccgattgagatgacttcgttctgacggcccaagtagtataggcataattgagcccgtcacaaatgataggatctgtactagtccgtgagttgcactgcagtcccttttcgtcggaaacaaattcctgtagctgtctcttttcgacagaaaaaaaaatcttccaacttcgttttcgtcacaatgctcaaattatcatactaatctcactatcaattccatcatctaaactcttgaacaagccgtcacaatttattctcttttgcagttttcctactgttttgagttgcagaactaaggtgactaaccgtgaactaatttatagtccaaaatagatcgtaaaacctatttattttgggaaatgctataggatggtatcctgttcggacgggatgatacttttgaggtatcaactgatacaggacgagatgatatctgacaggtatcaacccatccaaatgggataccatcttgtaccattccccataataaatgggccgcatgaagtccattccgcacgtagggtgtgatcctgttattgggccgcacgtgatcgagatctcgtt

SEQ ID NO: 109264 - DNA, 725 bp, Oryza sativa
tatggacaatgaagtcttgtaatacaaaacggatgaagtattagcccatgaggatgagaatacactgtacacccctgacctgacgtcctgggggcttttaactatttgccattcttacgtatattgcttaacgatttgccactagacccatatgtgatagacacatgagggcccacatgtcatttacagggtgtggcaaatcgttaattgccatgtcacaggagtggcaaatagttaaatttcccgatgtcctgaccccaccacggctttcatcaaaaacccgccgccaccgccaccgccaccgccgccgccgccggcacattctccggcatcctccggccatttccggtgaaactcaccgccgccggaagcgtgtctctcgcggcgcgatgtctacgcatcttaccaagaacccatcgcccctgttgcatcgccatctccatctcctcctgcagccccgccgcctctgcagcagcgccaccgccggcgaactcgcctcggaatccgcatccgtcggacgggcggtttaccgggtggacgacgacctcgcggaggagtcgaggagcaggctcgtgcgcgacacctgcaggctgctcgagctccgggagtcgtggagcccgaagctggaggcccagctccgccacctcctccgcgtgctctcgccgccgcaggtccgcgccgtgctgcgcgcgcaggcgcggggggacgtccgccgcgcgttcgag

SEQ ID NO: 109265 - DNA, 2901 bp, Oryza sativa
ttttacgcataaccggtacttataattgataataggtgcaggtttgttccgaataaccaacacctttataccagtacctatttgacgttgtgtagtattgtctgttggttggttaattggtcacataatacacgtacgtaggaccctgcaaatttagtgatccctagccaagaaatttagtaccaattgattgattgcatgcatgaatctatctatacatgctaattgcaagggttggatttgacctaaatatctgtaccaacttagtgccacctgtactccatgattagcgaaaaaccaatcaattaatatggcccttgcagtacgtaccaggacacgtcctagtctcatatgtggtctcaggttcatcagctcatagctagcttagtaatatatcttagtaccaaagggcttgatagctgcagctgctacttcacatctgcataatttaatttgttccaatatgtcctggacattccaacaaaaaatatgtgtccttttggttcagcaagcatatgccattttgcatctatatatggaacatgaattagttcattgattccaattgatcagctacatgttttgtcatagtcccttttcttatgccacaattgtgcttagcaccaaatacagttctaaattagtgaacagttcagtttctgcaacaatgttcagaaaatatttctgaatctcaatgacccaaaagtccttaattaagtcgatctatatgatgctgaaaacttgattgacatgaagaaacaaatataaaccaatgttccaaaaacttcaaccaacttatatacagatatagaattcagtttctgcagcaatatttctgaaaaaaaattctgaatctaaactacgcctaattattaattaagtcctaagtcgatgctgaaattggttgagatgaagaagcaaaaacaaactgaagttcgaaaatttccaaccaacttatatacttatatacagatgcgtatggatggatcacaattcagacaaactttgatcgaaactgtgtaatcgacatgagttgcatgagagatcgaatagggtttggtagcacctaggacacgattggcacacatatgtacgtggccatggaggaaacacattaataactagtagttcttgatatttctcccttttccccaattattgatcatcgatggatagctagcattctagaatgatgatcaccagatgcgtatgtacgttccatcatatcaggcagccagggcacacaagagaacaaatcaaagggcgatcgatttgatgtgatatcaactgcatatttgcatggaatttgtgccaagtctttcggctataatgatttggttgtgtgtcttcttgaattggacccagctgctttgcaatcattcattcacaagagtccagcggctaagtcatttcaaccatcaccatgttactgcagatatgtactcctatatatgttcagaaacgagttgttaagcactagctagctactaaccaatttaatctagttttaatttgccaggagtgtgctaatggccttttgaaccatctcattcagattggatgtattggagttacccctctgtgttcactgtccataggtggtatagctagctagttagttgctctgaattatgtgaggtggccatcatggtttctagtctctctatcccaaaacaaaaatatagtgacctttagaattaatattttatcccaaatataacaacttttttacccctaactattcatagtatccttggcttcatgatggtttgtgtttgcttagctttgtttctactatcgtgaactttttgtgtgagttctgtaataattggatgtagctctttgagtaaaggtcgggatgtttcattccattatctaaaaatcacccctgccctggactcacacccaccgaccctgagaggcaaacatgtatttttactctcttctccttaatactcatgtcactacctagaaattactatattataggatagacgaaaggagtacttattaaatatttaatcatggtcttttctttttgctttttctaaaaagccggaccaatatgatctactttctagaaaatctttaatctgttttcctgccataatatatatcctgagtgtaaaaataaatcacatgatagagaaagatatgtacgttacgttgcaaaattcgattgcgctatgttatatacttatatttaaggaaaaatacatataaaaaggtcttattttgaaacaaaactaacacataaatataatggttcaaccaaaaaatatatatttgagattaatatggttgagggccaaagtatgatcaatcctttcatggatgttaggttgtgtggatatgagaggagggagtatgctcctaacttacttttcaaaccaaaagcatggttgtttttctcatgcatatatatcccaaagagagaggccatattgcttgtcctggcctgccggccaacttgtactatagagacccaatctggtctcacctctgcaaattgcactgcattacatggctaaattcaacaccaaatccagcagctccctttgctttacatgccctctccattcaggcatgcaaaaaccaccatgccattgccatccagccacaacattactattaactattaaattattcacccattcattaaaaaaacattagtattaattaggaggagagctacttgtgatgccacactccctccattcacttgcactctctagacactcacaaacacacacacaacacacaccaatcattcattccctctctcacatttgtgtacaaccacaagcctacacctacacaacaattagcatttagtagcatgcaatgcaaccacacacacacacacatatccctcctataaaagggacatctcacaccaca

SEQ ID NO: 109266 - DNA, 3136 bp, Oryza sativa
aaattttcagctagatatctcctaactaaaagacctcattaatcacaccacaacttgatcagtattacctcgcgaaaacacttgcctaacaaagtatagcgagctgaatccgtccatgaacaaaggttaagggttcaacttaatatagccgattagcctcgacggttggggcggcgacacgtgttgcgccgcagctggggccatatgcatccaccttgtgacttgacttgtgtgtagctaggtgctgaggtgataggagttggtaccatacttcagccggcgtttgctacactttttctaacagatgaagctcaatcagggagccctggccatgcctcccttgatggagacaaacatgccttgcacttgcaactctatacatatagggctacatgattcaaattgattatatacacaattcaaataagtatgaattttttttaaatgtttagatattaacattaactactttactaattagttcaaactagtttgaactgaatttgaacatgtttttattagaatttgattctaggtatataacatccaaacatataattagttaggtatataatattgaattgtgaaataaagttaaatttgagttgttttgttgctaggtataggtatgaatcaaatacttataactaggtatatactcacaatttgaaaatttttaaaaatttagacgaatttgtgtatttcataccatggtgcccgggcaccatggtgccccatatgagtgtcatacatacatacatacatacatacatacatacatacatacatatgtgtatatatatatatatatatatatatatatatatatgtatatatatatatatatatatatatatagacacacacacatttattgttcaaacaacatatgtgcacaattgtcttcctccactgggatttctagagttcatcaaatggactagtgtgtcatacaataaagaaaagatcaaaaggcattgcctaccaatgagggcattctcctaccatgcatctaaccagcatagtatagtactctggcaataagtgaaagaaacatcgtttttgacttttaaaagtgaatatatagtgttgcttttactactaaacttctagttacctcactagtgcgagaattaacagctcacggactgacaatgtaggttcgttggtttcctcgtttatttgcatgcaatttccttgtttttcttcattagcacgtatcctaagtgtaaaaacggtctgatatataaaaaaacactttttatatagaagttcctttagaaaaacaaataaactcattttacaagtttataataattaatacttaattaatcatatataaatgacttgtcttattttacgacaagtgtaacatctacagttccctgtaactgggcctttccaacaaaggaatactcctagattttatgggattctcacacagtcaattcttttgaaaattcttggaatggagtgttcaattcctataaaattcctaggagccctaagttgctaaatccatgggctcatatactccattctgaactttaatttaccttagttgcactaaattgaagtagaatatatatccttggaggcttgaatgcataaaaattgcatatgcttaatccatacgaagcctcgctagattgcaaatgaggtagtaaaattaatagtgcattttttgtcgatttaagtacaccatagacaacgccatccttttcagatgcaaaaaagacaaaatattttttttaaaacaaaacgttggtgccttccatggttcaacttgacggaggaaataaccagtgattggaagaaacaattcagccactaattaataaagtatttaaaatttaagtatatgtttaattatcatcatcatgaccatcacgttggcttgttttcctccaatcacaagtcaatggccagttgttcagtgttgctgttattggccctgttattttcatctgcttaaattgattggcagtattcataataaaaaaaaactcactatatgccatgatactatttagaaaattattccctaataaagacacgagatagatagatgaaaccgtcaagaacaacaaacgacatgatgttctaaatctccagaaaagtccggaaatattatatagttgacgtacatgtgcaagtacagattaattatgctgaaagctatggaatgcatgggcacgaagtcttatcactgattcatgaataattgttttatagctcctgttatttcaatgcataattaacttgagatttaaatcgcttcaagtgagacctcagcaactcaaagtatgcaagctctactgctctagagcaaaatataatcacaattatgaaactttataaacacgaatatatatatatatatatatatatatatatatatatatatatatatatatatatatatatatatatagtttgctcacacattaaccaaataaaaacaatgctattttcatatattaatccgtggcaccatactttgataattaaacttatagacatcttcaaataaccatacctacctccagaacaaaacatgcacttatgaacaaatcatagagaatatgcattatgtctatcattcaatgattgtgctactgattttgtcactaattaattaataagcgagcaaaaaaaagaaatgcaaaaacgtgtgcatgtttttctgacacgtggcactctccgacagaacaggaataaaaaggtaatgatgaaaaaggaggggtctggaaatgacaaaacaaaaataatcaattcgttaattgatgcagtcatcgattcagtcatcatttgtttaccaatcatcgtagtacttagttttcacaggtgaatacaaattaaaaggctttgagctggactctagctagtactactaacttcaaccctctgtgaggtacatggtgcacaaattaagtagcaaagtacgtaattgatccggtgtctgaatcttgatcgtacatagtaattgcatatacgtatatacttataaacgagagcttgaaaggtgaaatttcagaaaaatgttttattgcttacttcctccgtttcataatgtaagtcattctagcattttccatatttatatattgatgttaatctagagggctgcaggaat

SEQ ID NO: 109267 - DNA, 2855 bp, Oryza sativa
cttacattgtgaaacggagaaagtagtcggtaactcggtatactctctgtccacgaatatatggggtttttgattattaaaattttatccgtagatataaggaatttggaagtattgatttttcagtccattcaaccattgtgttcgccggtgggtacatagctagacatgatctttcctaatcaagtaaacttgtagggacctggttgacaggtttttttttctcgaaaatttaaccgtcagctagcatcaaagtaatttcaccttaagaactctgctaatcaacctaaaatcttttacatccctggacaaagtgagtactcctactatatatgaagctcatttcagtgatgtactgacgtgcgcctgctgaattctctgctagctcccacagtatatatttcaaacttaagcaacacacttaattaagtacagtatatataggcgaattgaccgatctttttctagagctttaatcctctcttctccgtacgcaccgtacggggtgcagtgtacttgtctatatttgctttggaaattaagacccgactaagacgtatacggagtatgtgctagctactagtagctgcttcatcggattaattgtttagggcctggtaaaatttttcaccctgtcacatcgaatatttgaataagtattaaatataaataaaaaataactaattacatatattgcgtgtaaattgcgagacgaatcttttaaacctaattactccatgatttaacaatgtggtgctagagtaaatatttgctaatgatagattaattagacttaataaattcgtctcgcagtttacatgcggaatctgtaatttgtttcgttattagactatatttaatacttcaaatatgtatccatatatctgatgtgacatgctaaaactttacttccatagatctaaacaccacctcaatcttcatcagagctagcatgcatgttgagttgccagctgcaaatgcaattgtattatttatcaagtggtcaattggtcatccaaacaaaaaatgctttcagattagggaagctactccctccatcccataatataaaaaaaatttcggtgaatgtgacgcatcatagtataatgaattttaataaacttgtactaggatgtgtcatacatccatctaaaatctcttatattatgggacagatggagtagaatgctagctactcccttcaggaaaaagagtatatacgaagttacagtgttgctatagtttaagatggagggaatagataaaatgatgtttattagttacatatatgcacatcgatataatgggtaaaattaatgtgattacaacacttgtactaaaaatctcgatcaactgtacttgcatttgaccagcttaattaatttgctatgcgtgttcttcagccttttcattctcatgatctggacaaggactgaactgggatcgatcgatgcaaaaatatacaatgttttatcgatgaatcgtttcatcgatctggtgtactttcctgcgaatcgaagcatactgatttgggaatgtggttgatccccaattggtgcatgctcatctcgatcaaaaaaaaaggggggaaaacaaactgaactgaattagcttttaattggacgattcgtccttacattcgtgcttgcattcatgagcctaaagctgaattagcttttgtggagttgaagagttgtagcatgcgcgtcctctcgatcgacaagaacataatatactccatcgctagtaacatgcatatgggtgctagctttattatatactatcagcttttgatttatcggtgcttgcaaaagcctacgtaaaagatagcacacctgcatccctgtataatccatgcatgcactgatatgatatgcaggtcctggtggaaaaatagcttatggggctggagtcgaaggagcttttatagacatagaaatcataatacattggtgcagaaatcatttttctaggcggcgtataatccgtttacacgggtgattcctgacctgcctctagccgatggcctgcacaaatcaagtatttttacgggcgcccaaaaaagaaccgtacgtgaaaatacatttacaaatgcaaatatctttaagtttccgctgcaagaaaaatacatttttcacgggctattttttaaaacaactgctcgtgaaagcatttttcgcatgtgatttggttaggaaatcctcctgccatgtagaacgagatagcaaccttcaggagcagcaagtgcccattgtaagttgcgagcttgtcctgaggccatccggccgagggcacgcctgcctggacgtcacgaaacccgtcaaaaaaaagttaggagcatgtcaaatcattggtgttttactgccctctttcttatttgaaatagaaagaaagggatataattaacgcagtggtggatatagtggcgggatattatggcttgggtagccaaatactccccatcctaaaatgcaaggcaatattactttcaaaaatcaaattttggattaatatttatatactaacaatgagtaaaatatgcatgcgcagaattatgcatacactcattgatactatcaccttgatattaagtgcttgtttagattgatactaatttgtgtgctagcttcaataatatcaaaaagatgtttaccataaaccctaaaccctttggtttgctactaaaatttttgcccaaatgagttcaaattctatactactcctatcgttagaaaaaaataagtatttctagattgtctagcaattactaatgttatgcaaaatatttcttttcagttaattcatttgtcaaattttgaattttgaattgttatgattctctttccaagcatctg

SEQ ID NO: 109268 - DNA, 2094 bp, Oryza sativa
ggcgatggtggttgatggaatggattggtgaagcagagcttcggggttgtggggctatggttattgatgatcgatgatgggcaaggaagggattggggtcctatttatagggctagaagaagtggatgagctcgggcaccgtcatcgccatggatgagctcgaactttagatatggctggggtggaaagggctgtgagagggcggccaagatcaatttgagtggcggaagaccacgtttgaatacttactggcgaaggattggcttgatcgcgagtagaaacggctggcgacgtgttggcgccaatccgggcgcgacgtgcggcggcggcgagggtggaaacggccgactcgggggtgaatggtttgaattgtgaggggggaaaccaccgtctaactttaatccaaccatgcggcaagaattggcgtgattcaccccgggtagaagcgcaatcgcactcggcggcggcttggacgggagcgcacggcgtcgagtggcgattccttgcggcggtcttcatcccggctttgttgtcgccgtgattggtgcggctgcggtggtctgagggcgtcaaacggctagcggcgcgccaaggcgatcgggcacgcgcgatcgatctcgagaccgacgcgcggcggcacggcgcgcggctaagtcggatgtccgagcggcgcacgtgaaggggaggaagaagcaaagaaagccacggttttgagtggggtgtggtcccctaagatcaattctagactttgcacaagattgggtggtggttgggctgctctagttgggctgggcatttcatcgagcaccttatgtgcaaagaacagtgaatttcagaaattttgattattttcctagagaagattgaatttaaactatgaattttagaagggtttcactagggtttgaagtaaagcaaatcctcactaaagttagggtaaactaaggaaataatctatagtttgaaatttgagagaatttgctcaaattcactaaggtttggaataaagggaatatttagggtaaattagtagggttctaaggaagtaacacttgaaccaattagaaatcaaataaatatttaaaacacacaagattaattaaaagccagcatgatgcagttaaattttagtttagaatttgagaatgttacagcgtggcgatgaggagatggggacgctgaggagacaggaagcgtagtggatgacggcggcgagcaggaggacggggcgttgtcgtgggggcgacgtcggtgctgcccgcctggatcgggtggtacttttccgcgtagaacaccgtgctcgcggccgtcgccgcctcccccgccactcatctcgccgccggtggcgcttccctcctgcgcgactcgctggccgggactgagcaagaggcgctgctggtggcaccggcggggaggggcgtcggtgccgcccggtggctgtttggagcgagagggaaggggcggagcaggatttgacgacgtgggcggggattttgcgatggggaagaggcggatttggcgacaatttcttttgagaagtgctaattggagggttaatgggccggtgctaattgcaattacaactcgttgctttttatattagtctggactaggggcctgttcactttgctgccatttttaaccttaccaaattttgataaagttgctaaaaaaatagctacattttgtttgctaccaaattttggtaaattactagcaaaggtgcccgtgcgttgcaacgggaagtgtacagaaaaaaaattgagaaaaaattacattatgtaattaattaaaatatttggtatttttaagtaggtaggtgtataattaaatcaatttacaagtaaagcaagtgtgcaaaataaaatgacatggttaaatttaattttattaaattctccattattagttacgctttttggaattttattggaattatcagagcttaaattgctaatttttaataatacaaacatcatttaacaattatttaattggaaaaaataaaatcaaaatcctcctatgtttgggccgaatatagcaaagtttatatcccctcccttttgtctattctatgtgtctggcatgttttct

SEQ ID NO: 109269 - DNA, 1221 bp, Oryza sativa
aaaatttaacatgaggtagaatctcatggaaataatcctttgagtctttattctccacaaattcatgtgtttttcctgcggctcaatcaaacgatcattcctatgttttttatgtgttttgtaattcttcattttacaattgtattcgtgtcaaaatcctatatttttcatattcctctgtttttttattcatgtgattcaaaggagcccatacaattatttttaagtattggaatccttggtgaaaaaattaccatgacaccctttgtaccagagtaatagtattgcaaggttactatgagttgcttccctatacacttcatttcataagaaatttaacatgagctcatatctcttgttttatttttttaaattttttcctcaatctctactctctttccgcataggatttcctctaaaatttatgtatttgaatttttgtgaaccatccaaatatattacatctattgttcctatctattcctacgttgttagcttcccatactcccacattgttcaaaggtggcaagagtacgtacaacattgtgtatctgttttgtaagttattaactaaattgatatgagttattaagtaagacattgtaaaatgccatgttcatgcatagcctgataagaacagtttacaaatgacataatttcgtaagtgaatttgcttcagttatataaatgctcatgtcatagcaaacgctttccttataaaatacacaaacataaagatattagttcacaccatggtaatctaaagtataaaccacgctaaaaaaggacttcaatgaaaaaaacaagcaaggcatatgccattgaaagcgaatattcatgtgcattaccacaccatgcctttcttaacacctaaccttgcttttggaagagcaagacaccgtcaaatttgattcatgaaaacgcacacaagaaaggtaaaggaagtatcaagttgcaattagttactattagcacatggagtctgtactataaaatcaatagaccggaacaaacatcaaagaaaccaatcaaagataactttaataaaaaaccattgattttagatgcaactaatcaaacacttatccatgtggcaaatctatgggcctccctttttcttatagtcttctgggtctccatttttaagtcttttgggtcaaattcttttaggaagaagtcgtttgggttaatttttctgatataggtcatttgggtcaattt

SEQ ID NO: 109270 - DNA, 1631 bp, Oryza sativa
aagctaaaatggactttttttccctataaaactaaagtgggaatgtttggcgttgtagaaccaattatccccaagttaaaaactgaaatttaactattcaaatgaactatgatcaaattttacgaaaatttagaagacacttgaccccttagtggaattttcttgaaatttggttgaagttgataaaaattacatatttttgtttctagtagaggaaaaagggagataaaggtgttttgtctaattcccctatgaaaatttatcaaatttgattgtacaatgaaatttctcataatttatatatatccaaccatattatgatgaatgaatattgcatgattatacccatatagcataatcaataagtttattattgaagtgtggttaaagtttaaatataaatggtggcgtcagatgacaagtttcgtaaaaggaggtagtaattagttgaaaagttcagtttagaaaaataaatactagttttgttgttaaaataagtggttgtcctaggtttgccggattgcttgattgcaacaagcagcaactgtgctattctccagatcccagtgacatggcatttcatttcgccaatgctctatgcttcacatatggctctcaagtaccaccatcatgtcagcatgtcacgaagtcccattgccagtggccgcaccaatggttagcagttgctctgcctctacacaccaaatgcaccatcattagtcgtctcctctcacgactacctcatccgctagtatgcccatgattatgtgctcacgaatcagttagtcgcaaattaaagctagctcacatacttgttgcatcctcacccgtgattgaggatgcgtggcacacacaaaaggagaagatgcaacaaccaattaaggtgatgttggcctgcaatgctgacgggaaactatttttcgttttaatagtctattatagtgttggttcaaatagatctactaatgcccagtacaaagaaaaatatgtaacataggatatagattaagatatgcccatatctccaaacaaatatttaacacactttgttcaacttcacaggcatccaaaataattaaactaataaatattataagtaacaaactatattatatttgggtaaaatggccctaaggtttatagtattaggttgtaacttcatcaaatatctcaacaccttaaaatccaaataaccaatactccctccatcccattttaagtgcgacaagtttccgcgcccaactttgataattcgtcttatttaaaattttttataattagtatttttattattatgagatgataaagtatgaatagtactttatacataacttatgcttttaatttttttttaaatttttttcaaataagatagatggtcaaagttgtgtaaaaaaatcatggctgcacttaaatggaacggatggagtaccttttaaccatttttaattcaatggatagtaatgctgatgtattcacattagtttcactagaaaattattattttttcaacgtaccaggtacattcaacacatgtttttgatctcacatacaaaggctaacatccaacggagcaattttacaagaaacaatctgcttccgcccaatacttttataaaaaaacccctagc

SEQ ID NO: 109271 - DNA, 1739 bp, Oryza sativa
cccctagccacctcagcatcgccccgccacgtcggcagggggacggcgccaaagaggctggcgctgtcctgttgaacgacggcgccagccactctggcgccctaaaaaggataatttttgggataagtttttctaggggtctagttacgaaataagtttttcaaaagaaccaaaatgtgaaaaatccagggtagctagggtggtacttgtcgttgaccttgacataatttggaattattgggcctttaatagatgtcacaagtacatgtgtgcaaccttgttgtgcatcataacagcagcagagatcgtgacagctcaagttaaccgcatgccccctttcagctttacaattaaatctgagggtccctttgaatcacaggaataagaaaacggaggaataggaaaaatataggattctgacaggaatgtaaatgtaaaatagaggattacaaaacacaggaaaaacataggaatgaccgtttgattggaccacaggaaaaacacaagaatttgaggagagataaagacttaaaggatttcttccacgaggttctacctcttgttaaaattcctccaaaacttatatatgaagaggcattctataggaatttcataggattccatagggttcattcctttgattcaaagggatttgtaggaaaaattcctatagaaatgaaatcttctaaaattcctatgaatttcctttgaatcaaaaggggcctgaaggtttttaccattcctgtagttatgcatgctgcacacctaatccctgttattccagatcagatcagggtgaagttttggtgatcgatccaggaatttttttggatcaatatgattaacaaacagaagatatatgagctatttgattcgaatgattacatttgatcctacatgcccatttttcttttggcttgcgcaatagaatgtaatagtcccatgatgtatcgaccgtctcctttggagtttggaacaaggaattttgcagaaattaaacaagtttttgtaaaattgctgcgttccaaaagaactattgttttgaacagctcaaaccacagcctattcacaggaaaatacagcaagggcttgttcggttttgaacggctcaaaccacacagcctaaggcttgttcggttaatccatataaggaagacattagaggggaattaacttcacatgtggaattaatccctttcaaccttttgaaccttttgggaggaattaagaagggattagaggagattgaaggagatctattccacaccttccccaaattctcctcaatccttaggtgaggaattaacggaacaaggtctaaagcagatgcacatgttactgcagttgaaaaaaaatctaaccctcctacagttccagttgcagtcagcttactgtcacactatgcaaaatggtaaaaggctgttactgtctgaagctgttttcttcctacgatgtcctggtccaaggaatggcatgtgaaaatgaagtgttgagaaaaagatgaaagcatcggccctgaaaagcatacagatgctacagctaaaataaaaatcatatgtgaattgaatcatattagtgtgttgtcaaccacaaatctatgatgaactatgcatgcaatcttcatgaatggtatgtttattgcctttttccctgatgggtaatctaagggtgaaagcatggtgtaacataaagcagtcaaggtacaattttttataacatcagagctgcaatgctctacc

SEQ ID NO: 109272 - DNA, 2559 bp, Oryza sativa
ggggcgagcggcgcggagcattgcggcggcggcggcgagaagagacgagaagaagaaataaagaaagaaaagaaaagggaaacgtgtttggtgggccgtatcgaggcccatttcatgggtgaagtcggctgggcccatttcgaatgaagagtgggtagggctggatggatctatgttttttttctcattggagtaagtctattttacctctctcattatcttgccccttaatcgaaccgcatccctcaacgggtccccctattacgcgattgatcgctggcgcctgcggcgagcgatcggggaaggacccacttgtatgcctaacttgcgtgtgtggaggacgggagatcgaaacgagaaaaaaaactggttcgttggttttgccttttttctgtcttacatacaactggtttgttggtattctaaccattgcttcacatatttttcagtaatttgggatgatctaaatcctagtgtaattaggatgtagttgtgggccactgggccctaacatgttacttcctacgtacgtttacttttgacatataaactaactgtgtctaaaccctatacatacaaatttttgtagaaaatttatacacgtaaacttttaatatagaaactttataggtataaactttagatctataaactttctatagatgaattcaaacgaatttaaaaaataaattttaaaaagtcccacatagatattcgcaaaaagaaatgatatgcacgtacacacgtctccttaggaagaagaaaaggaaaaaaaagcgctaacttggctccatgaaaatcggtaatagtaaaaaaaaaggaaaataaaaacagttaaggagcaatttctaacataaaaaggtaaaaaaaaagatgactcgatcacgtgggcgcacggatggcgatcgtccgcccgttagcaatttcgtccctcaaccacacaaccaagtataactccatcctcaacttgaaaatggtttatgctgagttagcagaaaatactttaaacaataatagtgaccccatgtgtcatcccctctctctctttccctcttctctctccttccaccgcctccccagcctccgcttggtgggttgtattttggcccattgctgaggtgcagaagatttgtggcccgttttgcatgaacggccagttcagtttggttgtttggataggcctagatggtccatgtttttttctttttcttttccaaactcattcgtgtgtgttgcggggtaccgaaaacctagtgctctctctgttttaaattaagggacattgtagattgacgtcaaaatgtgccctactaatttatcggtagtttaaatagtaaatgtgatagtttagtttaatgctaaatagttggtaatgcccatgcttttattataagatttgccatcatgttgctaacaaaacattaataacgaaaaaaagtattaacagccgcatcatttgcttgttggcttatcagacgtaatcagaatttaaatttcaaaagttaattttagatttgattttaaagtttcattagtagtttattattttttaacataagcttttataagttactaaaggatacaagtatataaaacttctacttataaattattttagttgctttagtttgtttttctacggattatcaagtagggatcaaacaatgagaagtgctaaaagaactcgcgcaatccttgacttcaccagagctatttacgcatttcatctccttttctctctgactgatctaatattcttccctgttggaagcttccattgtacggtaacgtaccattgaattttcagaccgaatcgaatcgaagcaggttttccaggatacacatcatcatacatgatgaaaccaagaattcgtcgttcaaagttctaaaatcgagaaagagaagcagtatcaatttagtacttttataatttatatttacgcctgcgggcaacggacgctgtctgatgcgagacaacatcaggcaaattacatcgatcgtcgacaagttaactaactccatccaccactgctggatcgatttcatcatacatatatgtgcaaaacggaatcaaatcgcttctcattctagcagagatcagagtctgaactcgggaaattaaacagcagttcaattgtctaatcaacgtttgctcttccttctcttctagcagagaattgcagaaaatgatgatagagattaataataaaaaactttcgcggacaagtcgatgcaactgatgatgatgccagatatggatcttgttcaagtgcagacaaatcgtgatatcgaccaaattttcagagcgaaccgaagcatcgatcgatcgatcgtctcgcccggtgcagttttttttccagctccagccaagaaaatctcttcttccaggatatacacatgatcagacacggaagaacttgccgttgaaagctctgctgtttttgttcttgagaaaacaaagttacgttgtcgtgtaaagaggagcacggtcagtcagtattcgtgcagagatagatcactgtctgaaaaaaaagaacagttcaagattctcttcttccg

SEQ ID NO: 109273 - DNA, 4504 bp, Oryza sativa
agactaaaaatgcttatatttgagaacggagggagtactcatttagatccccaaacaaccccaaagatcccgctaacgagtaaatcatcaaattttctcagaaaccatggcagctctctactagcgttaccgacagacatatgacgctgaacagcaatctttttgttgatagattgatatatatatatcgtcgcaaattctaggatgtagtgactcccaaattaaattaagcaagtgatgatcgatgcgacgtcgacaacagggctggattttttttttctggtttggtttatttgaaatcttatcatctttgcttttacaaagttcacatgtcgtctctaggcattttctttcaatccctttccgagagcattaattagttgaggtagaattatgcagtgcgtataattgccgtgttgggtgggcaccataacatgatgtgcttctgccaccgttcaaggtgcacaatacgttgttactgtattatcagggtttttctgcttgcagctgtattgtaaaatggttctatggccaaagtatatactccctctattttatattataatatattttgatttttctaaaattaaacttctttaaatttaaagatagagaaatgtagtaactttttaaacatgaaataaatatattatcaaaataaaatcaatgttagatttaatcaaactaatttaattttataaatattattatgttttttataaacttggtcaaactaaatttaagaaagtttaacttaaaaaaagtcaaagcgttcgtaccagtatatatcaagctttcgtcatccccctaagatagaacaaattattttgttaaaatttattatacccatatttaaatatataatattgttgactttattcggtctttagtactcctatgtaacatttatctctgtttttattgaaatataacaataacatctaacaaaattatagcatgtaaaagtatataacgaaaaatatacccatatgattcttatgttctcaatatatttttttttaagaattattgatggttaaagttttaaaagtttgattggatagtcaacattgtcatactttaaataaggagttagctagtagtactagattttaatggaaattcccatataaaataaaataaaaaaatgtgttaaaaggaggatggatatttcagttaaaaagtacagggaggacaagccagatgatatgactctaggttacttttgtaccagctaatttgatgcaatggaattgactaataatgtggtgaggacagtgaggaggggcccatgggagtggtacctatgatgttgcagggtggccatgcagtagatgagctagaaaagtgagtggccatgtccttgattagcatggcctaacaatcaagtgagcaatggtaatatcttggttgctttgacatgtcatcatcattgatttattattggcaactatacattgcccacaatagggtgggataagataaacctaggcatctttttatctttattttctctcattcttaacggatatactatttatcggatgtctaagatcattgcccattaatagatctcaatccaacagctacggtttaatttatctttccctttaactagaagtctagagcccaaaatatgtaaggagtgtttaagagagtccaaggtgacaaaagaccatgccacacttcaatgaaatgtgataggaagaaccatggattgtggtgcagtagcagtgatgccgcctcaaccacaagataatatgatgatagtagataaggttggtaataatgatgagagagatcagcggcacagaacaatgcaacaacgacaagtctgatggcgcaaatcgtgacatataagataggacatatggggtaatggagtatcatcacggaagatgaagaaacgtgtgaccgacaacaatgatgtgcaacaacaaaataagcagcacataggacaggggaagacgtggcctggttttgtgacatagaatccatatcaaattgtgtatgttgagacttgagatacgaggaagcaataactctaagagcccctttaaattggacggttggtaaatgaattttttttagattcagtacctttatgattttgttcttatggatccctctaattcataggaaaagggtaggaaactttcctctacttcaactcttcctatggtaccatcaaaggacatctcttcttatttcacgcgtttcaattcatataggattgaacaagcatatgctactttttaattcctatgtttttttttctatccaatgctttaaaggtgccctgaagtccaatgagattagagcaaactctaaatgaaatgaaagtgaatcgaattattgattgtgtagtaaacgcccttaattatgccttcatgccggaataggaacaaggtgcatgactcctcatagccaacatgaaaacggacagtaaaatcctattgcagttgtagtactagtatatattggtccaatttaggtcaactgcttctctctgaaatattgtctccttttccgacatactccatatgtagtcggaatgtttgtatgggcacgcgagtcggctcatgttatttttttccctcttaatttccaaattatggcaagttggtctcgtgttattttcagtccaagctctgttaatttaatcagtagtaccaaaacaagcagccgtgcatatcatctgtgtgctatattatatgccacacatgcagccatttgctttgtgttcccttctagaagcttaatcgatcgtatcaccgccctcttgccaattaattaagcatgggcttctagaagcttaatcatactgtagtaatatcttagtggagcagataattaattaattaacagtcatgcttaatttaatttgtgagttgtgaagccattcgaattttggacaatgaaaaagacacccatgcaggagattaatttaaaaaccaaaggacagaagggaatggaactcgaccaaaattaaaccatcgttcgttcgtactagtagcatgttgtggccattggcaatggaataaaagtttgaattcaaaagatagaatttgtttatgttctattgaggagagtgatttatttaattaatttgttccatcgcgtggcgtcaaaatcacggtgagataatggctggcgtcgcttgattgtgttttttttatcgtgacgcccaagtaattagtagtacttaattttttgttaatggaataaaacatcccggcctttactcatcagagctatagccaattattacaaaagtaacacccaaacactgagtgtagttcaaatgaattaaacacacctaacaaaataaaagatcaaactaagataaggagagtacatttattcaaatctatttgtgaatctccatccatagtttgcaaggagttgcatggccgttgtctcaagtctacgacatgcaatcttcataaactctcgatcatcttcacacatttgcagctgtacccaaaatcttaacgcctgtatatatttcgcatttatttattatttttcttcaaatatgctaatccttcctgctgctcgagcatgcatgtttcatctgcatctttaagaaatcttacaggttcagtttgactttattttcttcttaattttctgtccgtgttctcgatttccatcttatctcgtgtatcgcctgctgctcaaattctggcctcgttggctttcgaaatatacgaaaccattgacttttaatataacatttaattatttattttatttaaaaatttaatatagcataagttaaaattatttgatgataaaacaagtcacaataaaataaataatacttatatatatttttaaaatgagatgaagggacaatcgttggcatcatatattccggaacagaggaaggagtaattaagaagaagatcgcatctctgcgacgaacagataaagtaggttcatttacacgcactacttgcgatgcaaggcaaaccttaatttaggtcagacagcagaagcaaagaccaagaaattaaacgtatgtagtactccctcaatccctaaatattaacaccgttgacttttttaaatatatttgactgtttgtcttattaaaaaaataagtaattattaatttttttttctatcattttattcattgttaaatatacttttatgtatacatatagttttacatgattcacaaaggtttttgaataagatgaatggtcaaacatgtgttaaaaagtcaaccgcgtcaaacatttagggaaggagggagtattatttttgtcatataatcagaaggtcaaccatagtatctgtcacaacctgtttcagcgcgcatacggcacacaccgcgcactcgcgttcacggcagaaaaaaatgaataatacgcgcccgcccacaccttttttaaaatttgctgcaaatcccgaacgacttgttgctttcaaatacagaagattttcggccaacttgacccctcctccatctgcctggagatttaattgattg

SEQ ID NO: 109274 - DNA, 872 bp, Oryza sativa
tatatgctccttccacttcctttctagcttgcacaatgtgtgtgtgtgggggggggggggggggactggaggtgcctaccctttggacttggattttttcttttttttgctagtgttataaattttggagagaccagacacgtagttgttggtaatcggaacttgcacactgcatataaagaatccatttcatctccgtcataacttcgaatttacttcctacgctctgcattgtgcaacatggtaaagagcaatcgttttctcatgcacaaatgatccatatagcataaggtaattgaagaatatgaaattctgcaaaactgccaacacagattgctaaaaaaaaattctgcgaataaaatagcacaaggcacaaacttttgacatggctcaccaaattggaagccatttgaactgctaatgtttctgtatattattacttactaacgtcactttaaccatgaaaatctgaagtggagtagtaactcaacatcattattttacgccacttcaaccatggtggcctagtgggaacgctgctgtgattcgtgaagttaggaatttattctctttgcagtttgatgtgataaaggttgtgtattgtcgtagagcttgtaatagtgttgcgcatgactagcaaaaggtgctgcctttggttcctctactcctgtagtttggtcaggacagtttcctgagtttgtttgtaacctggtgaacagcgatatagctgttttggtcaagtaatgaagttcttttttcctctaaaaaaaacattgtggcctagtgggaatcttaccacaatgtcaatgtaaattgatactgccacaattaggcaacttctcttttcaaaaacaattaggcaactacaagta

SEQ ID NO: 109275 - DNA, 812 bp, Oryza sativa
agatttgcgggggcaaatccacccgtttgaacgcaagagagagagggaaaaatggggggaaagggagaggggatcacggggagtatttccccccactttattgcacgcggggacggcgggatgcggcggatttggcggcggcggcgtcgcttggcgcgggcggagcggcgggagtggcgggaggacggggatgatgggtgggccccacccgtcagcgagggtggcgggtgggcccgcccgtcagcggcgcgcgcgcggggagggaggccgaatgggccgcgggggagaggagagagagaggggggagagagatgggccgggccggcccaaggaagggaagggggacttttagggtttttctttttataaaactttttcaactttgtttatttcttaataattattatttgtgctctgaaaattccactaaaatttatttacgcattttaggcttttaggaaatatacaaaaatcctctaagccttgtttgacttttactttgcacattttattttttggaggctttcacacggattttaattattctaggcgtaatttaaaggatatattttagggtcgttttgggcgtgacacaccacaagtggcagcaatgttccgaagagggggaggaagttctcctctgtacccgggacccgccggaaggcgatgagcccagcggtaagcttctctttcgtccttgagtacgtagtcagaacgacttaacctcacatcatattatcttactcaggacttgggtgcgtctccaccgcctcagcgaaagcagaggttggtgacggtcggcgagaagtaag

SEQ ID NO: 109276 - DNA, 1334 bp, Oryza sativa
tagaccgtaattccgctgctgttttcttttcttttgtaagtatgtaacgttattattatgatggatttgtatattaaattgtcagtttgtgtacctcggctgattcctggacgaggattttatgcacaaataagttcggaaattactagtgaatttctgggcgtgacatgtggtcagtgtggctctggtacaagcatccgaagtgggccataagctagtgtattttgtgtccgaagcactacaaggggcgaagaccatgcttgagactagatgacggtggttgtcaaaggggccttcgccgttgtggctgttcaaaccgcggcatgtgaggtcgaagccactgccttggacggtactggtacggttggggccgcggcggggctgaaggctggacagcctgcatcgccctcggtggcggtacgccaccgtcttaggcggtcaaaagctctactccctcttcacccgccatctcctcttcgccttcgcccccctttcgcctaggcacaactctctctttcacggtcttttttggtggcatctgtggttttgctctgggttccccacggacggcgccaggtgttgtcgaatgacaactgcttcacgtcgaaggacgcggtaaacttgatgtgtggttggaatagtaaagcaatgtattaattgataaaaatttttgggattccccattacatggccctagggggctatttataatccttgtataggctcatactctctagggtttggttagtataggggaatttacatggttacccttatgatagggacattataataggtatacagtgtcttttgtattcatggaccttgaggcggcccccttaggccggcccattagctagcgaagggcctctatgggctgctgggcctcctaagcctttagccgaaggcatttgctactttgggcgatggctttgtgcttcgacttacagccttcgcccgtggtggatctttggttgatcaatgagcctagagccgaacccttcggtcttcattccatggcttcacccagtcatgatggtgaaacccccttggtcttcgtcattctgcttcgcccaaggactttgccccttggcttcgccaatggcacacgtctgggatttagccgatgtttgctattttggatggtttcggcaggtcggccgaaggcccttatgacatacctccaacatagaacatatgtacctttggttgattaatacataaggtattcatggttatatctaagctagttgtgtcctcatcatcctcatcgtcctcgatttcgccttgtcatggagcgtattgaacttatctttatctatcacaacatctgg

SEQ ID NO: 109277 - DNA, 1604 bp, Oryza sativa
ctaaaatctttgtagtcgaaaaaccacaacactcatcttcttgcaaaccaacctgtagctcatttagacaactagaggaactagatagagaattacttatacgcatgcggtcctctagacaatacatttcatcatgaaaaggaggtatagtcaaattcgaacaaacatatacttcatgcacattatattctcctttactatcataattgccaataacatgaaaaatcacatcagaagggcatggcaattcaaatctagcaaataatttcttctgtaagcagttgagtggacaaacatcatcaaattgaatatagccccaagtatttaaagaagatagcaatttaagctctttattctcgctagcaatgtgaataacatgtttgaactcaacacatggtggctctactatagaactaacatgttcattcactagttgtggcatggatagaagtgaaacatcacacaactattctttatcacaagaaacatcaagcaaattgttttatgacaaaggtatttcaacaattgtttccactatgcgttgctctaatgtagcataagtagtggacatagttggtgttgatatttcttaacgacattactagaaatcttcattcccagcaatggcgccagaaatagtcatggtatatgtatggttacaaaactaatccgcaagcgcacggatataccattgtagcattttacccggaagtattccaaggtatcgcatttttaataccaagagaagataataagagtgaacctcgctaatgcactttatacatatactacttataattgtcaaagcctaaacaatggttaaatgtaatatagcggtagagtgacacgaagcaaagctattcaatcctcataataggtaagtctaactaagtggaagaagaaatataaagcactcaattcctatgcttctaatatacactcaaatcctagtttacatccactaatatacaatcatgtggttatgtcacgccctaaaaatcttaaatatataaattgttgtttaattggaattttttagaaattatttttaaaagcctacaagctaaaccctaattttctaggaaaattttcaacataaaaatgagctagataaaattttattaaatactatgcttgctcctctattttctagaattttctgggaattatttgagcaagggaggtatttttttaataattgaaacaacatttcacaaattgttttatttgaaaaagttcaaaaaaccccttctttggtccttgggccgttttcggcccaactctctctttcctctctctccccgcgcgcggcccacgccggcccaagccgccgctgcccgctccccctctcgtggaggccgacaggtggggcccacctgtcaggtccatcccctacctccggccgccgccgcgcaagccgccgagccgccgttttgcgccgccgtttccgcccaaatccgacccggattcttccgattgattgaggggttttgttcctctcggtctcctctttctttcccctcaagaaacaaagaaatccgttgagtattttaaccgaatcgaattcgttttgtttttaaccctaaaaccgagttttaaatctt

SEQ ID NO: 109278 - DNA, 1118 bp, Oryza sativa
gggcaagatcgggcagccaaatttggtatcaacttgaagcttagacatcagagaaaatggtggtattaaaatttaagcggtacaccgcggagatctaaacatttcttctggatttataaaaaacatggataattagtccattttcagtgaattaccctttaatatatcatgaagattgtatttctattcattttaacccattcattcaacgaaatgaactatcaggaatatgtgagagcaatttcatatcaataacttaaaaacttcatgttgaattgaaagatttataaaataagtcactttcatatggctccggttagtctcatttcacaacgccccctatcgtcagagcatgatctgagtcggcagcctaacatgttagcctatggacgtttttttttaaaatcgttaaaaattcattttttgtttaaacgaaaagcacatccaccccgacgtacgttatcactagctctttcattggagccctcatgtctcattgacttttgaaagttcacccaccgtaatttttcaaaataggttgcaagctcgtcattgcctataatacacgtgtgaaacaagtctaactttggactcagtttaccaagcgatttgaaggttataggtcgagcacacgaaacataaaaagcgtgaattatcatagatcacttctgcctatttcattatgtccatttcatccaaccccccaccgtaatttttccatttagtaaaagcaaacattttgccgagtttagcaaaaacatgaatattcatgaacgatcagacaatacagcctttatagtacgtaacgtatagtgaatggaatgggcgatgatccgttcaggaggcagaggtcagtggtttgtgctggcaatgttcacgcgagcgaaaatgagacaatcggagcaatatgtgcactaaaactgtgaatatgtaggattttcctgtttgaagtagtaaatttatacccttattgtgcataccggaattaaatatttcactgaggtattcctcaatgtattacctttcaactgggcaagaaacaaattgaaaaataaaaatcacccaaacttagttttggcgcactttggttcctccctggcccaccggcgcatagtggg

SEQ ID NO: 109279 - DNA, 1331 bp, Oryza sativa
ccccccccttgagaaaaaaataatgtaaaatcacgtgatttttacgatttttttacgcgtttttcaaattttcgggagcaaaaaaaaaaaaaagttgggccccctcccctaagaaatcctggatccgcgcctgcctacagtattataggtccatgctgaaactctacacacactgctccgattagaccatgggccatggggggcaccatggtttgggggcacatacatgtaattgatcgacgccctggggaggggtctacaaaggttcaacctttctctgagtacgagcctaggccctgccctggccatatatcataactaaggcatagatctagaggtttataccgatcgcaattgtatgttattgttttgtttttaaggcggacagaattgagaggttatcaagctagagacagattaaattggtctgagctaagtcaattttagagtcttaatcttaaattgttttttgtaaattcatcaaggttcactggagaatggagttactcaagatcattgcatagggggtgtaattgtttggcattgactagcatgaccaactggaaataggaattgaaatttattaaatctagacatgcactcagccatcctcaacaatggcatggtgaaaaaaacacccataatcttacctgggaatgtcaccattttccacttaacaagtttaaacttcactgcttgtcaagcatagcaagctatttcctccttatcaaaagaaatgcacatcaagtatccctggcaattgcagcattatcttcaaactgtcagaaaagcttaattgttatgatatctatcttttatcattatttcattttttcaaacataggagacaacgtgccattccgggttaccatgctgaatgctatcgcaatttctgcaaaattatcaggccacagtacacacattatgtctagagcagacccctgacattccaagtccacatggtcatggttggaaagtggaagatggagaaatagatattatttggggacaacaacccccctgccatgggtgtcgatccgtaactgatacctattcatcaggggggatgatctattcattcatccccccccctgatgaataggtattacgtaagtatcgacacccttgccccctgcccctagcagtttgctagaactaacccactgcacttgcaagaagacaaactgcaaggtcccaagtgggaaaaacaagggaagatgctcttgccggcagcataatgtgccatgcaccgatctgtgcaagtgtactgattgtgaaaatccagttgatggaagatgcttacatgaagacacagacactgaagatcaaga

SEQ ID NO: 109280 - DNA, 1099 bp, Oryza sativa
tcacttttgaaggtgggaaagaatgatgcatttattcattgcccgatcacttggcattctaatcatttgtattgtcttcaaggaacaatgcatgagatcttaattatcctgaatttaaaaacgaaatatcatcaaggctatccaacataaaataactaactggatagggtgtaatgtatatatatatcttttaccgcaagggagttgtattttctctcgtgatcatatttggcctcggagcggcacacttcggaaaaatataacccacttcagcagtcaaaaaaattgttgtattacacatcctaccagtcaatatctatataatatcaacaagaagatattaattgcgttgttcattatacagtgcgtctcagaaaaaacgaaaccgagaattatcgatgtttttatcataacttagtcacatttataatcaataaatgacacatatttggaaagcttggatcctcttttttcagttaatgcaacccatatgatgcatatatttcacgcatgagtgataacaatcaatttgaagagaggaaaccaaaaagtcaattggcggacggtatctgaatttcaaagagaaaatcacatttctagaaagctgagtttctgcccttttatatgacatctcaatcacgaaaaatgagcaagggatgacaaagttctatttgtttgaagtagtgcttgcatttccataattttatcaaacgaattcgttttcacggactccctgccgtagcaacaagcaaaattgacaacgtttcgttgacaatcagtcatgcacgaattctctcgtctaagctttccaaatatgtgtcatttatcaattataattgtgattaagttatgttaaaacatcgataattcacgatttcgttttttctaggacacactgtatatgtagttttctgcacaatacatctttagattatatagatccaagtcacgtgaaaggtattgatgactgattaacttactgaatttaatataaaaaaaggggtagggctataggctcttgaaaaagagagggaaaatgtctgcccccccccccccccgattataaaagtgaaggacaacttagtgaaacatttgacaa

SEQ ID NO: 109281 - DNA, 565 bp, Oryza sativa
tgtacatgacgtcttgtaatccttttgagataatccaacatattcaatggataattttgacttatgaaactgacttcatagttacaacctctgttaatctcattaacttttacatcctagaaatatcttgatctccacatttgttcaaccactccaaaaatatccaatcgttcaagttgaaaatgttatactctaaattttcttttctctctacttaagcgagatccatggggggaaattacttttcagagtggaacattcatgctttgaaaaactcataccaagagcatagtgatttaaatatatcactaaaaatgtacataacagcacagttaataagtgaggatatgagcttaaattgtacagtaatcatggtatctaatggcgataccatccaggcaacagatatgacagatgagtctgtagaagaagaaatatcagaaaatatgagacaaagtttgtaatattgttaactcatgtacaccttttgtttttaactatttcacctgcgacattcttctcatctcagtatgatttcttttatagatgtttggagtatccagat

SEQ ID NO: 109282 - DNA, 989 bp, Oryza sativa
tgctactatctacatgttgtacatcaggccagtgctagaatttgcagcacctgtttggacatcagggatcacaaacaaccactctgtaagcatcgagcgagttcagaggagagctcttaggattattacctaccctgactctagaacttatgatgaactgcaatctcatcttggtgtctcctctcttaaagagagacgcacatccctttctctaagatttgcagaatcacttctccaatctaaggttcatcgacatctcctgcctgagagcagagttaatgactgtagccgcattctgcgaaatgcacttgatttgtccttgcctaagatgagaactacgaggtaccgaacttcccccatcccatctttcactcgatctttgaataataataaatagaggcttaggtaattatcagtataatgtatgtcatgtatttcagcaataatataattatgtgcaatattaattgtcatgatgattggcacagcaggttcttccattcattcatattttgatgttgcatgtacttttatccttcctctcactctctcatcccttttctctatctgaacttgccacttttcaaatttccttttcttcttcagttctgatctttcctctctatttctatttcactcccaccccctctctctcagctctgtctctctgtctgtctgtctctctctctctctttgctctctctgtctcttcctccttatccctttgtctctccttcctcccctctgtttctctctcccactttctgtccctccctcctcctctccacctcttttctcttatgatgttttacagtacaacattctataattatatttctataattatatgttatttttactgtgaccaataacacctaaggaattccattttttttgttgaaaataatgataaattgaggcttaggtaattatcagtatgttttatatgtcatgtatttcaccaatataattatgtgcaatattaactg

SEQ ID NO: 109283 - DNA, 3680 bp, Oryza sativa
tcccgcttgaagacattttcaagccccaccttttttagggaagttctaaactagtattatctttcaaatgccgttggaatttaaccttttcatttgttgggcctgcaaatgggacatagtacctttaatctccaataagtaaactacccattaggtatattgctcttttagtctaattcccagtttgtgcagttgtgcccgtattgtgtctactatctaaatgatctagtaatcataaataatgataataagtaatgattatcagacctttttggggatggtaaacgaaatgtgcattagaaattagatcatgtggatagtatagacgggctaggtgtagaccatatggaaattagacgaactagttgtagaccaaatagcaattaaccgtgtttctttaaagatataaactttcaagctgaacaacataatcttgatgttccctcttttaaagcggctcaccaaggatggattctgaaataagtcactttaggcttgagcctaaactttcttttttcttgaatagaatttacctaaattattacaaaaacacagccagattttcgtcagaaaagtagaatgttatatggttaacatacatgtacattgaatttgttttgctggaatacgcactacacacataagaatgatataactttacacaaagaaatgatatgcaaataatcaaccccccccccccccccaaaaaaaaaaaaaaaaataaataaaattaaaaaaaataaaacaaaaaaaaaaaaaaaaacatgtaggagtaaacaatgtctaaatttaagaaagtacagtataactcaccatactccttgactacaaatgtcgcacttgactcgacaaggaactaaaaaataggattaaatatgaaaattataatgagaggtaatagtgatttcaaactaggaccagactgaccagttgctggaatgggcctgctgcgaggtacgtgcacatgtactgtttatgttgatcatgaggctagaatagtgtaaagatggatctaggctagaatccactatactgccctctgcggtaaaaagcagtaaaacaatggattcgagcatactaattagatacgtgcagcaggctcctttcgataaaaatgtacccggcaactcctcgaatatcacaatttctgtggcatttcttagacgaaaaaggtcacttttaggggcatactgatggaatgcgctatttctaggcaagtgacggatccttctagctgatatcgggacaccggttccggatcggtgcacggccgtcgggacccggtttataaaattcccgacatgcatatggaaacgttgtatcatccgctcaatctgacttgcgtgcatagaacaaataagcatttttccatgaaaaagtgaagttttctcaaatgtgcgtttctttccagcattggggtgcccggaagtcactttggtaacatttcaaaaagtataatataaaaagacaattaatatgcaattttctgtacttttgtcggaaaaaacatattgtctagcacaatgtcgtctcttgttgcgttggagaagagcaaatagcgagtttcaatcacactttggccactttcgcaaggtctcactcgttccattgcggtcaagcggctttggggtaagtggctaatgaatatactaatcgttagctttcttctgcatggtattaaatttgttttgattttcagttggcaactttgaacagaagataagtctttttgcagatgacacaacttgttttttgaatggggaaacagtttcctttaaacatttatttgaaacgttgactcagtttgcaaaattttcaatttgtcacattaatttaagtaagtcagatgcaattcatataggaaagctgaaaggcagtacagttattccacaagatgcattagggttgaattggaaatcaaaaacgtttaaggctttaggagtggttttctcattgaacacaaaaatgctttacgaactgaattttgttcccagacttgtcattatagaacagattttaaattgttggaggcatagaagcctatccttgttgggcaaaattgctgttgtaaagtcgcttttactcccccaaatgttatttttgttttcagtattatgtattgacctgccaaactctttctttaaaagattaaatggtttgctttttaaattcatttggagcaatggcaatgacagagttaagagagatatattatgcaatgattatgaagaagggggtctaaggatgattaatcctttagtttttgcacaagcgcagaaagttttgtggatggctaaactattagacgataaatatgaaagttgttggaaaacaatagaaatatatattctttctatcttttgtgatgaccatcttgccctttttaaggcagatgcccctgattcggttttggcaaaacttaaaaattgccagttaacagcgtctattaagacatggtatttatataggcaagagatgaaaagagaactaggtttatgtcagtttcatttacaagattttatttggtggaatagaaatgtaagattgcaatatagaacacattttttctatccagtttggtatgaaaggggtattcattccatttttcaattacataatggttttggtaaccccaaaacatttgaagacctcgtaattgagtttgacattcctattagagaccaaaaaaaatatgactccctcatgaatggcatatttttggagtggtttgataattctcttaatgtggatgagaatatatttaatcaaatttttaaagatctattaagtcaaaagaaaatgtctaagtatacatataatattttgctgaagaaatatagttgtactaatgccaaaagggagagtaaatgggaggaactatttggccatcaacccaaagagaaggattggtcgattattcatacgagtaacttttgttgcacgattgagactcagttaaggagtttttatttcaaaattttccataatgctattggttttaatgcatttttgttcaagattgggagaaaggagtctgctaattgttatttttgttcagattttccagaactttagatcacttgttttgtgactgtaggagagttttaccactgtgggaaaaattggtggataagattaacactggcactgatcacagttataatctgactttgtcaaaatttaattttttgtttgggatacagtcaagggacaaatacgcctcttgtataaattttctctgtttatgtttaaaatattatatttactcatgtaggtttcagggaaaagaacttattttcgaagcatttgtttcaatggtaaagttcaaacaaaaaatagaatataaaattgcccaaaagaaaaataagttacaagtccattttaagaaatggtctatcaagtttaactgaaatttaggagtagtcttgcaaagctctgttgtcattaacatcttcattgactttttgaaatgtaaacttgccctctgggaaagtatgtgagtgtgtgtgtgtgtgtgtgtgtatgtgtgcatgtttatgggtgcatgagtgcgtgcctgttttgtagttttaagatattatattttatattgctcttttactctgttaatttttcaaaaataacaataaaaacagaagaaaaaaaaagaaaaaaaaatgttttgattggttgtatatttt

SEQ ID NO: 109284 - DNA, 3637 bp, Oryza sativa
tttgtgaattcgggctgaaagtttcagtaaaagtaacattcatgtgacaaaagaattcgggcctgaaagtttcagtaaaagtaacattcatgtgacaagttaacatcaaatgaaaagcaaagcacaaatgtcacacatgtattcctattcacgaaattgaatgcgaatacataccaccgtctgtccggtgcatatttgaaagctcgttttgcacggctccgtgacaagagtataacatcgcacgctacttaatcgaattaaacgacgcaataagctttttgaatgttgatttacatataagtcattcaatttggcacgaaattgaatggacgtaatgttaattcaggtgctaagtttacggagttgggcggaaaacctatataattatcatcatcacgattattgtattattgtatgatgacgatattaccattatcattatcattattattattatcatcatcatcatcatcatcatcatcatcatcatcataaattctattattataaaagcgaaacatgaatgtacatttaatgacaaacatgaaaggaatacatataataataaacttcacaaataacatcgggcaatcagttaggcctaccgaaattggttccccgcccaattccatatttttgtcactcaaatgaaataaagtggattcaaattcatataattgtaagtatatttcaaacttgcggtaacaaatataacagattacctctcgatccgatggaagcatttcctgatccaaggacatgaccttgattatcactggaatgaacaatgaaataaaaagagttgaattattatccatacagaacaagaccacaacgactatcgacaaatcatgaagaaaacttttaataatactattcacgttcacacatcaatatatagttgggaggcacaaggttattgaaatagccgtatattgatttttttattaattctttcgaagttttgcgatcgttttacagattctgtgtgtgtgcatttgtgcgtgtgtgtgcgtgtgtgtgtgtgtgtgtgtgtgtgttgtgtgcgtttgcatgtgttttttgtttcggccgggggatagtggtgtgtttggtcgaatggtttttgttttgttttatgttaccactgatttcattttttgttcatcattcgtagaatctatgaattgaaaacgaattgaattatgtcaagatgaaaacaaattgtgggtaggtagacttgcatttcaatttggttcgaagggatgactttcagtgtggttagaatggataatgggtctggtatcgtatgacattattcaactaaactgaactaacctttgtaacaagtcgaatggcatgagagtataaaaacaagttaattggtacagaaattaaagaccatcaatactactgggccagaagggattataccaaacagcgaggtcactgacaggtggctatcttattaactcaactaacataagaaaaagaggatcatgggggactaacaggcaccgattggggaagttctctatatagagggagcaagtagctacaagtaggacagtgggactttaaaagaaatcggcgaaatatatggtattcatgttatgtatagtactatgaacaagggaaaagtttcgaaaataatatcgctagtgatattcgtttgtctcgcaatgtggtcaataaggaatctaaaagatcacgacgtttcgtatgctactgcgatacttcgtcaggtgataaaaactactgtaagcaagggtcttttatactcgacgggaggaccgtgcggagcggtccataattcgatcgataattggaacaataacgcacaatgcctattggtcgacgcacacggtgatcgaccaatcaccaggccgctggattcggccgctggttcggctaatacaccaggcctattggccgacgcatacggtactcagccaatcaacgggccgctggatcggaccgtctgctgaatggaatcgaccagtgttggctggcaggacggcgagtgtcatggcggcgtatcgtccgcatccaaaattcggggatatcgatcccgttgtctctgttgaaattattaggattgagacggatattgatagcttctttcaccctccgtgtataccaatgcctttcctgggaaaggcactgaaccccgtcccagtctggttgatgctggttatcccaagcatgttcggctacggctgagttgtcagttcgacggagtctgacgtcccttttatgctcagtgattctttcttttatcggacgggcagcttcaccgatgtaggatctatcacatcctttacaagggatgttgtacacaatgccgtcccgtctatgtggaggaattggatccttggggcatgtaagttgttgacgtagggtggtatctgatctgaaaaccgttcgaatgccatggctctctaggcggcgcttgagttgttgggagaccccatcaatgtacggcaagactgtaaaagtcttgtataccttctgatccctgggttccgacgatctattcttggtattgtgtataaaacggcgtgggtaaccgttgagactcagggcgctgcgaacacgggtccgttctttgcatggctgttgtggacttgtcacaatgcgtgaagctctgtcaaatagacatttcactagacctctcttcaccgatatgggatggtgagagtcaaacgatatgtactagctggtctgtgtgggtaggcttcctatagactgaggtggagagcctatggttgtcgtgtctatgaactagagtgtctaagaatgctatcttcccttcacactctatctctgatgtgaactggatggttggttcaaggctattcatgtgtttaagcagcttatctgtttcagagatgggaactatgatgaaggtgtcatctacgtatctcttccaaacacgaggtatgcaagagaggggacatgtgtccagcgcttcttcttcgaaactctccatgtataggttggccactacagccgagactggactgcccatggctgccccttctgtctgttcatagtatgaacctttatacagaaaatatgtggatcgtagaacaaactcgaggagttgagtgagttgttccggtgagagtgcggtacgggtagacaaattgctgtctgattgtaagcgttgcaatgtagcattgcatgcgccctcaatcggtacattggtgaagagtgaaactacgtcaaacgaaaccatgcgttcttatacacaataccaagaatagatcgtcggaacccagggatcagaaggtatacaagacttttacagtcttgccgtacattggtggggtctcccaacaactcaagcgccgcctagagagccatggcattcgaacggttttcagatcagataccaccctacgtcaacaacttacacgccccaaggatccaattcctccacatagacgggacggcattgtgtacaacatcccttgtaaaggatgtgatagatcctacatcggtgaaactgcccgtccgataaaagaaagaatcactgagcataaaagggacgtcagactccgtcgaactgacaactcagccgtagccgaacatgcttgggataaccagcatcaaccagactgggacggggttcagtgcctttcccaggaaaggc

SEQ ID NO: 109285 - DNA, 3204 bp, Oryza sativa
agattagtgccccatatggaaacgtttggttggatttgtctcataaaagaagttgaccacaaaccaatatcccacacagtgttgagtgcaggggtcaagggccattggcttcatcgggcaggtagttccattatatgaatgagtaaattccgacaacaatattgaaccaatcaaaacaagtttaataccagaagaaagctaacgattagtatattcataagccgctcgcgtcttattttttcgtaccacggcgagcccagattccagtatgaactcatttccatacagaacaagctaggaaagcttgcaaagaggtcacaaacaattggactttgaataattgtgtattgctttgccttacttatttataaaggcaaaaaaaaaaaaatgagatttgaaccctcacgtcaactcctaatttctattagtatcacgctgtctttaccaattgagctagcgatgagttgattaaagattgatttgtataataactatcaccctattaaccaccctaccggattccacgtgcgcatgcgctggtttcctttgcgaacgcgcatgcgcaggtccccctcgcgagctcaatctgggctcgccgtggtacgaaaaaataagacgctagccgctcaccccaaagctgcctgaccataatggaacgagtgagggcttgcgagaccgaccgaagtgcaattgaaactctcatctctgataattgcccccttttattctgacacgtgccccttcctttttctttctaaaaaatgccgcttttcctactgataaatgcccccccccccttttttataaataagagccccatccccttctcataaattcccctactcataactctgattagtacctctattaaaatgtaacaggtgccccttttcctactacaagtgccaattttccctcataataagtgcctctgtacatctcaagtgagtgccccttttcatttccggtgagggctctcattcgaatttgagagatgcccccttgaattttgtttataagtgcccccttttatctgtaataattgcgtttgttattttgacacgtgcccccttttcctacctgattagtaccatttttcttctgataattgcctttaattctcctttataataagtgccccttttccattctcatgaatgccttattcatctctagtgagcgccccttatcaggtgcgagaactgccccattttcacctctgataattcccctttttaatttgacacgcgccccttttattttctaataagtgtcattttccgtgtagatatgtgtcttttttcatttcaccataaaatgtactcataatttatagcaactaatagcaaatgctaaatatattactcattgcggatatagtatcgaaaataatatcgctagtgatattcgtttgtctcgcaatgtggtcaataaggaatctaaaaggtcacgacgtttcgtatgctactgcgatacttcgtcaggtgataaaaactgttgtaagcaagggtcttttatactttacgggaggaccgtaaagcggtctaaaattcgatcgataattggaacaataacgcccaatgcctattggtcgacgcacacggtgatctaccaatcaccaaggccgctggttcggccgctggttcggctgatgcaccaggcctattggcctattggcctattggcctattggcccatattaatttcgcccatagctcgctcactacgctcgctcacatttaaagtttatataattatgttttttattaaatatctgttcagtctttcatgattagattgtgcttacaacaacatcataacttttttctttctctttattagatgtagtttttcgccctgcgacctcataaatctaaaagatttttgctcgctcgattcgcgagctcgcaaataaatatattcagaccatcacacccaactgcaaaatcatgatgcttaagcattatcttgacctatgtaaagagagtaacaaacattataatcatccgtcataatataatcacaatgtagggatgtataccaatgtctaaacgtggcatattttccctttgaggtttcccttaaagtaggtgcccctttttcttggtgcccctttactttgtaagacgctccacgacctctggataatgggtgggatattgacttatcatctcattgctcaaagtgtaaagagtattaatgttaagtgactctcacactctgccgtgtaggcctaccgtgtgccaccgtgcgcgaaaatgtctgcggacggtggagaacggcgagggcacacggtggttcgttatcaaagcgggcaacacgttaatagggcgttggcgcttatttacacccggtgggacccggcgaaagttttgggcatgttcaaaactttggccgggtggcaccggctgcaagtaagcggcaagaggacgatgttgaacggtatgaggacggtatgaatacgttatgaaaacggtcacactgtatgaacacgttcacaacacgctcataacccgttacagaacggtgatgaacgggcaaaaaaatcggggtatttatggcagtcgtgtcatgacgtcagcagtccggggactcgctcacaggacgctccgagcggtgaggggacgctaagtgactggtaggtggctgctacaaacccggtgcacacgttcgagacccggtatgggcccggtatggaaacggccaaaattttcaacaaaagtcaatctgggcggtgaagacggtagaagcacgttcaacacccggtatgcgcccggtgagaacggtcagaagatggcaacgaaacggtgaaaagattaattttatgaattgttttttttgcggccggggacaagttcgctcaaaacccgacgttctggactctgttgttttttaatagcccggcaggtggacggtaggcctacacggcagagtgtgagagctccattagcaatcaagtaattttgtatagtggatagatgcaaagaactttagcctcatgaataatcaacgtaacagacaacagtacgccttagctagaacgtagtttgtatttaatagcctacatcttgaccgttatcgtcaatatccgcattttccctagaaaacaattgcccattatatgccagctggggcgatgcggattcttttctgccccagttttttgttttgctcattacgccactggatacacatcccaaccca

SEQ ID NO: 109286 - DNA, 3206 bp, Oryza sativa
gtgcagttgtgatccccatcaggtaattaccttatttatacccttcgctcctctaattacaagaagaaaaaaaatcaccccacatggccctgcccatccgcccctcctgtcattggtaagataatactcactagagaatatgaacaatttaacccctttctatttcacgtgagaatgtacgtacttgttccttgaaacaatttgtttatattaattccttgttgagctagaatcaggaagtgtttggagccaggataatggcatgttttcctcttatcttatgatctaggaggtcataacctgttctgttccgatgctctgtttaatttgtgttaaagctatgacattcagcttttggagatggaaattaaacattaccatagttcaccgaaaaacattgggtgcaagataagttgaatccctctatgccacatataattttacttggcgtttcaatgaattaaaaaagaaaaaaaaagaaaagaaagaaagaaaaaatacattataggcctacgtaagaaagaaaaaaaacaaaaacaagggaagaaactgaaagtaagcaaaaacatagaaagaaagaaaatttaagtaagttagaaagaaagaaagaaagaatcgaaaggaagaaagaaagagagaaaattcaagtaaatactaatgcaagagggaaataaaactagagctttgctttttcaagtacccgaaaagtgcgcattttacgtaaggaaaatgttcctttttcttcctaataagcgctccttaatccccattgtcataagtgtcccttgttacctttgataagtgtccctatccagatctgatagttgcctattgtatttggaaaagtgtctcttttcctttgtagtaagtgcattttccccttttgataggtgcccctttttatttctgattaaagcccatttttgtatatatttatatcataaatgcccactttcctttcaaatacgtggcttttgcccttctgaatagtgcccctttgtttctttcaaaaaaaaattctcctttaatatcctcaaaatacccctttttgcccccggtaaaagccccctcttaaatatgacaaattcccccttgttactttgatgaatatccattttccttatcaataattgccctcccaggtcgaaattccagttgataccagttgaaaccagtaaggatttccaactggtatctactggtttgaactggtctcaactggtatcaactggtctcaactggtaccagttgataccagttgatacaatttggaaaccagtagaaataccagttgacatctgagaccagttgatattaccagttgatttaccagttgctttaccagttgaaaaccagtagatgattacaagttgatttaccagttggaaaccagtagatgatcaccagttgatttaccagttgaaaaccattagatgattaccagttgatttaccagttgaaaaccagtagatgattaccagttgatttcccagttgaaaaccagtagatgagtaccagttgatttaccagttgaaaaccagtagatgattaccagttgatttaccagttgaaaaccagtagatgattaccagttgatttcccagttgaaaaccagtagatgattaccagttgatttaccagttgaaaaccagtagatgattaccagttgatttcccagttgaaaaccagtagatgattaccagttgatttaccagttgaaaaccagtacgaataccagttgatttaccagttgaaaaaccagtttaatgtatcttatgaatattcatgattaattcgcatgttgtcacagaaaatataattatcatgttctggtaaatcaactggtaattcaactggtaaatcaactggtcccagatagcgttgtttcaatttccatattaaaaaccagttgaacctactggtttcaactggtaccagttgatttactggttttaactggtaccagttgcctactggtttcaactggaattccgacctgggctttgaaaagtgtacctttttatcgaaatttcccaccgtcccttacaaaatgtactcttttggggtcatctaaagagccacatggagtttaaaagaatcgaagcaactttgtgtagtactactacaggttccctatttcaaccaccacaatgaaaggcagtgcatacagttgaagacaaggaagggttctttactctagaggtgttgttctagaggtgtcgatcacaaggtccgcggttcgagtcccgccgccgcactaatgtcctttggcaagatattgatctacatttgccacactccacccaggtgaagtaaatgggtacctggtacgaatttattcgttgaaacgcagcgcgcgtaacagctgcactgctaaagccagggtaattatgctgcattattgtagagcgcttagagacttctgataaagtaagtgttaggcgctatataagcaaggataattattattattattatcatctatcattgattactttgcatgtaaatcttgcattgtatggccaaatatataaacatatcaattatattctttttactgtactaacgctttaacatgccaaaaatctggaaaaattctcaaacttcaaagatatctttgaaggcgtcaatgtgtaacccgctctaacagtaaattctcccaaccatattttgaattttcccaaccgtttttctattaaaataagacataaaacagtcttttaaaattcttttaacacttacacgtttgaatggtatatagagccaattcattgccttgtgacgatataaattcacataagattaattaaattataatagtataatgctaaatatattactcattgcggatatagtatcgaaaataatatcgctagtgatattcgtttgtctcgcaatgtggtcaataaggaatctaaaagatcacgacgtttcgtatgctactgcaatacttcgtcaggtgataaaaactgttgtaagcaagggtcttttatactttacgggaggaccgtaaagcggtctaaaattcgatcgataattggaacaataacgcccaatgcctattggtcgacgcacacggtgatcgaccaatcaccaaggccgctggttcggccgctggttcagctgatgcaccaggcctattggccgacgcatacggtactcgaccaatcaacgggccgctggctcgggccgtctgctgaatggaa

SEQ ID NO: 109287 - DNA, 1519 bp, Oryza sativa
  unsure (1)..(1519): unsure at all n locations
tctttaacattattatatgacatgcatgacataaatagcgccgtctacagatctgaagatggctttctgtctggtaccgtagctccatcgtgcctggccaaacccgtaccctttaggggattcaatactttaagataagatgaatacccaatcactgaccgactttgcaaaaaatgtcctcaaaatttacagctgtcaagaaaattcgaaataactttagcttgctcaaaagtggcaatctttttacctagtacgtcaatgaaactagggagacataattaatccataaacgcatatggaaacgttttcttggatttgtctcaaaaactgaatgacactttaaaaccaaaatgcatttcctttctggcaattggagtacaaagaataattgcaggtgaatgaaacgctttaacaccacaaacacctgaaaaggaaatttgaatacatttagctgataaacgactccgcatacatatggacgtttagtggagcaagaaacactggattcttgaggaaaaaaaacacgaactcatttagcagaaagtcggtacgcaaattagatttggcgcggttgaaaaatacatctttctacgctgcgactttaatggtacaatctagtataaaattaagacagtaaaattgctcttttttttttaaatttttcatttaataaaacccaaaacttcagtggtattagacgaattaatgttttattctactaataattacaaatggtgtatacacattgtgaaactgtagcattttacaataaattacgttgattagcaatgatgatgtccttagaacctatttatttgcgcgtgcatccgggacttcagacgatgaagattattggtcaagcgtttatggtttcttttattccgataaaaatatacaatcaatcaaaacaagtttgataccaaaagaaagctaacaaatcgtttattcattagccgctcacccaaaatcagcctgaccacaatggaacgagtgagagcttgcgaaagcgaccgaaatgtgattggaaaccttgtatcatccgctcaatctgacttgcgtgcataaaacaaataagcatttttgcatgaaaatgtgatttttttttttttaaagtgcgtttctttcgggctttggggtgccagggtggcaattgggtaacctttcattaagtatgatataaaaagataatatgcaatttctctgtacttttgtcgggaaaaaacatgcaaatgcagcacaatgtcgtctcgttttgcattggagaagatcaaaatagctagtttcaatcatatggacaactgtctgtaaagtttggttaaaatgtgattacgtcatcgcaaagttatcgcccaaaatgatgtatttttggatttttttttttttttttctcccnncatcaaaaaaaaaaaaaaaaaaaaaaaaattcccatggttgacctaaaaaagctgaccttacccccctccccaacggaggaaaaggtcaaattttcaaatttcgagaccaaaaaaaaaaaaaaat

SEQ ID NO: 109288 - DNA, 1829 bp, Oryza sativa
atccaaacttcgtatttgtatccaatatttgagcatgtttattgcttaaagtttattgttcaccgttgaggatttcttccaatgttcggctagattgctgcaatctttattataataaagtcctgttttccctgtattttctttatgtctgttgcactagctcccaaaatttctgatccataaagcaaaataggtcgtatagttgcataaaaaaggtataataaggctttaatcctgggcgtataattgcccaaagatttatacagtttaaataatgatatcatggccttatccgctaagtcccttgtcgccatttaaacgatccaatattactaaaaacaatgcctgaatattcattttctttaccgagctaagttttttcccttttatttaaatttcacttttatcatttaacctgcctgatttattaaatattaaacgtaatacaaagttttggtatgggtttatgactttggttcaaatgaacatattgatcgctgtcgcgattaaaatcgagtctgaagttatgcaattgtgaatattaaactctgtatgttgtatagatctctctcaagattgattttactttagcttcaaaacaatgttgttgttttttactaaaatcatgattataatgatatagttgtttcgttgaatggtaacattattgatcgttgttcttctttaaaaaaaattggatgtgactattgataataagttatcctttaatgagcattttgaagtcatttgcacgaaaatttctaaaagtataggtattctaaataagttaaagcatttcccacaaaatatactcaaaatgatctataattccattttgtttgccttatttttaatactgtaacctagcctggaattcctcggctacatattcaatgctacgtttatacagattacaaaaaagggcagtgagaatcattttgcatgctaattttcttgcccttacaaagccgttatttaataaactgaatatgttgaatatatttgatgtttctgattatgaaattgcaacttttatttaaaaattacataccaaacagcatttcagaatttttttcagaagttattctgtaaatcttcaatctggtcttgtactcatactctctttttatcctaatttcaaatgttcagtttttttctgtagatggcatttccttcctttctagctgcctcctcattcacataaatactcacttttgctatttttttgtccagatcaccttattttgtacttttatcttatgtaatgtttgtttattttgactatatatcttgtgactttgtatgttattgtatctaaatgttttttatgatgaatggaataaacttgattatcttatcttatctatctatcttatagtatggccgcaggcactatttgaaaatgttatcgggagcatcgataaatttgatattttaatttttcgaaatccttagcgttttagaggctaatttttcaaatttacttattttaacactaggtttcgcaatggtaatgaagattttaaatttcataatccaatcctgttgaaatattaccaaaattggtaatacctttaatattttacatccaggagttacaataaaacttgtactcacatgtacatgtacccgtctggcattaagattgttgaaatttctatttgattctttgtcttaatagtattaacttcatctctaagttaccatgctcaaaacttgttaatttgagtgactcaataactgttgtttgataaagattccttagatcgtatatctgaaatggccaaatccattctcttagacaggcccgaaactaagggggggggggt

SEQ ID NO: 109289 - DNA, 1039 bp, Oryza sativa
aataaaggtatataattattattcaattgactatattatgatatgtgtattttgaattttgttaatgtacctcggttacttaaatgatcagatcgaaacaaaataatgataatatcaataatgataatgatatgaaggtcgcataattcaacatcaaaacgcccaaaacgcccaaaacgcccatcaatgcccacactttgccactttttcaacaattaaagcttctaaatgtttatgatataaaattattgctatatgtttatgtgttctaagggattattgccaaggtccatgtcatgtaaatttactttcaattatgaaatacattcttatgaaacccgtaggccctaatgctggtaattttcattttcctaaaatccgtacaaatgtttaaaaaatacagtttttttcaaagggccagttttgtggaaaactatcccatttaatataaaaaaactctacttcactgaatatttttaaacgaatgtataaatcccatcttttattattgtattcaatctcaaaataaataacgtttcagttaatgcactttttaatgtgttccccctccccttcttcctttttttgttttcttcttttgtattggtgtttagattctctcggctttccttttccttttttcttttctcaacaatacagtgtatactttttaaggggttggcgttcataaggctaattgccctttttgttaaccccacattcccataaaattttgtttgctccttccctttgtatttttcttgtaatcgatcttttatctgtataccacgtttgtatgtttttaatgtttttatggagaatgaaataaatgaaatgaaatgaaatgaaatataaatatgtccttactatacaattctctttcgttcatggctcgtaatcgttggaatgatgagccacagccaaatttgatttatatgtttttgtaatacatggcaaactttcatattttctttggagcgtattgagctttgagctagcctgagtattaggaatttggaccaccaagattattatcgtt

SEQ ID NO: 109290 - DNA, 3182 bp, Oryza sativa
  unsure (1)..(3182): unsure at all n locations
tcctgcagcccgggtctggagaaaagactacgctcaatactcatgttcttccacaggaataagatgatggggtcttagttttgaagatttttaaaaagttttgaaataaccgggtctggaagaaaaactacgctctaaacctaaacccatgctttattaccgggtcttagtttggaagatgattgggtcttattnaatttttttttttttttttttttttttttttttttttaacttgggaataaccgggtctggaggaacgactaccctcgattctcatgttattccacaaaaaaaggattatggggtcttaaatttgaaaatttttttaattttttgaaataaccgggtctggagtaaaaactgcgctatacccatgctttattacagggttttagttttgaacaaattcgacaaaatatcacttcaaatttattacatttgggggtaaagtcattattacatttgggggcgattcaaaattattacatttgggggtgaaatcattacatttgggggtaaagggttattacatttgggggcgttattacatttgtgggtgtaacatcccctgtgtgtgactgggcctttaaggaagacaaatgtaattttcaaatacaaatggtataaacacttgaattcctagataggattttccaccaaaaagttaggaaccagtacacagacggcttcaacagggaaattatgttcacctttactttattgtggattcctaagtagaattcgatgcttaaaatgatgccaccgactgatttgtgaaaatctgtgcccacagttcccaaatcttatgttttaagggacccactattgtttgtatcgtgcatttgagaagaattttttaagctgaaaattaatgtttggtgtaaaatgtttggtgtgaaacccactatgaacaatacaatggtattaagacccacagaagacaaaaggaacagtcaaaagtactgctcttaactattttctgggggtttaaggagtacagtagatttccacttcagtataaaattacaagattacattgtggacattaggctttgatggccaaataggtctcacttacataaaattgtatttgaagagccaaaatgtattacatctgacaaagttatattttctttacaaagacatttataagtgtgttatagaaaaggtagttgttaatacttaatttaaccatattacattgtgctgaaccctttaatgatactcatggatacaaataactattcaccatgggtacctacgtaatccttccatcacaatgctttaggctgggccccacactaacttttttggaaggctgtccggatttcaatttttagagtatgaatgtaaaaacccatttaaaagttttaaatttgggggttccagactgaagtattgggcgtccatgtgtcttgggcgcgtgttagtgtcgagccctgcgtatggtccaatttcttgatgaaatcgtatatatgggcccaggcgcgtacgcaagggggtggttttgggggtcaacccccccctcaactttgttttatgtgtgtgtttcggaagaaacccccctcactttttttccagtgtaaaaaaaaaaaccgggggaaaaaacccgacgccactccccccccccccaccccccactgaacacaaaatcggtcggtataattgttcaatttccggaggaaaaaaatactctccccccttataacccccagaaaatagtttacagcagtcctcttgactgtttaaagtatctgatcctttaggacattttcgcgaagaatccaactatgtgtagtgccggcataatcatcaggtcatggttttgatttgtttcccttacaaattactattcattttcctctttaatgttctgctttcatattttctagtcttttgtttttccttcttcttttcttacaaagatctttctcaagttattccttgttattttttcttctccttcaaggagagtttcttcttcttcccatttggaacagtttaagaactgtatgagcttgactgaactttcatgccacatgtgtgtatagttccatagacacatttctgtgtgcaatgcatatgacttctagcatatcaagtccattcttatccattcaatgattataaaaccgcacagtatatgctggttcttatttacatgaacatgtattatataataaatctttcctaatggcttccacactgtttcttttataatgcattcacttgactgaacttaattttatcttgaaaagaatatatcccttacccctgtcaatggacctcttctttcttgtaggttcatccacgcattcaatctctgtgatcattgatacaaaatataaaaccggaattaaaatttcaatataaacaaaatatatatatatatatatatatataaacaataataataaataacatgtctgtatcaacaatttatacatttgaaggcaataaatcatataatggcaaactgaatatctaacattctttaaatttagatatcgtgatattgaatattttgatattatgcaggcctactataagaaaatattgtgatttcttgtatattcatgaagtctattactctttgtttagtttgctttcttattgttcctataaacaaacataaattactgtatgtacattctgtttttggtttaacaggggcctgctgtataaaaagcattcagagaggcaaagaaggcaaccaaagtgttaaaaatcaaaacagacaaacagatatacagtcatgcaattaaaaaagctatcagcacaattatcaaacagaacctcacttgtcctcttaccttcacgaatagcaacatccagacctgcgttggtaagtacagtcattccagaatccttatagtgattacaaaaataatgaattaaaaacaaatcacagtatctttatttttcatttttctatttgacatttgacaaagataaacattcaggtaaataaatgtcaattagtgtttacatccccctcctctccctccctctctttccctctctctctctctatgactatctatctatccaggcgcggatccaggatttcttaggggggggggccaaatttgaaattttgcgagccaaatattcgtacgtaaaggtgaccagcagtgacgtaatgcaggggggagggtgggtgcagggtgggggggggg

SEQ ID NO: 109291 - DNA, 3315 bp, Oryza sativa
ggggggggccaaggcccgctcggccccccctggatccgcgcctgtatctatcttcctattattctctctcagtaattgtacatgtatctctagtgatctacttttagtgcccttttatcccacagcacagtgtcttctttgagtgatgtttttgcatgctaataattacaaattatatatgaaaagaaagagcaaaaatcacagataattgtgagtctatttaaactgcagtgcgatgtgtcattcttaaatatcagcgaatttatttgtaacaaattgattttttttttcgagggggggggttaattttgtttctttcacattggtttttttactaaatatttttaaaaaaatcaaacgaggaaggagtggaaaaataagattaattgttgccaatttgaggaggaaaagcttaataatttagaaattaagaaaactctaaactgctatgggttatagtcatccacttggttctcgtcggccttatgccaaaagggccttaacccgatttggggggttattgagttattaacatcaccttgtagatttcaccattctctttaaaatgatgtgcttcacttgataatttagaaattaagaaaactctaaactgctatgggttatagtcatccacttggttctcgtcggccttatgccaaaagggccttaacccgatttggggggttattgagttattaacatcaccttgtagatttcaccattctctttaaaatgatgtgcttcacttgatgaaattcgatttatttatgaagataattatgaatttcaaaagggccttaacgcgtatctcatctttttccttacgccaaaagggccttaacctacacggcaaatcttttatcaatgacagattatttcgtaatttccatttaattcaatgaatatcggtagaaacaccattaaaaacatgattagtctacaatagacagaatgtacttaaaataatcagtgaaagtatatgtcgtgaatttagatcatgaaatctgagtgaaatttaaattaggtgtggatgcatgaaatgcgaccgactcgttggaatacgcagatgtcaacgtatgggactgtgatgaaaataaacaacgaaaaaggtgtcctaaatgtacgatctctaaaaaataactttactgaaagctgcattatattaataaaaatattcagatatcaaaaatacttttccaaacattttaattcatcagttttatcagttttcgtgatctagtagccgtaggaggggctttctggcaaaccaaaggtgttgcgagacaagaaaatttccttatgccagaagggcgctaactatgcgcgcgtacttttggcaaaacgccgcgtcggttacgccccttttggcataatgccgagtaggataaggcccttctggcataaatacgctacattcaagccttatgccaaaaaggccctaacgtgttttttttgcacatagcatgtacaattctgaatattttataacacatttaacacatttcatgtaaaacttaataacttaacacatttaccgaaattggcttcaaaaacaaaaaaagaccacaaacttttgattattagagaggccaaaacctttaaacgcgattatctcggaatggccaaaagcagttaaggcccttttggcataaggccgacgttctatttcttctgccctatagctcgactatatatgctttttatatatctgacttgtcttcctctctaatttcattgcagtaaatggctgaggtgtgaatgttttaacagtttacattatacaatatcatacaatcacaataataatgaataaaaaatcttcatccttatatatttaatttttcagaattttgcttgatattttccacttcatgtcccagtgaacattaattgttatgaacatacacacatgcacatgtacactctgtaggcctaatctcatcattgtttattaaaccatcaattttcatgtgcatggaacttttgcgaattacgggaggggtccagatctgcgaaattgaaatggcacaaacatttgtggttatagtcgccattagtcgttcaggtgtttagtatatatatatatatatatatcgaaatctggaggtaaacatacctaacaaaatctgcttaaaactgactaacattatactaacgcttcatgaatagcttatttttaaatggaatttgctcaatcctacagtcctacaccaatcccttttttctcatttttcttcatctttttaaaaccaactaaatatcagggttatattttaacccaaataagactggaggatgattaccccccaccccctcttctatttttgcaatgactttgtaatgcttaaatattttacggtgccacttcgtgactgtttttgtttagagtcttgcgcatattttgataccaaatttgcgcacactgggtcaacggtccgggggttatgtaacattttgtgatcgtgtgttatggaattaaaaaaaaaagctcttctatatataacagacagagtttttagatgcaccttttacactgtatgttgcagttttatacctaccttttcaaatgtgcttttagtattcccatttggcatggtgaataaagcttattgcattctcattcgcataaaacgatacaatatataaagaataatacaaagaataaaaaagactaaaaactaaaacaaagaaaaatataaaaacatagaaaaaacataggaaatggtaaaactaaatcaaaatcatgattatcctgttgctatctttaatatttgtgtaaaaagtgaaaatttgtgaaactttcatatttgcataattagttagtactaattacaagttgtagaataagtaattaaaacaatgtacatgtacatgtatgcatcatttagatcatatgaaaaactatacaaaagacaaataaaccagcactccaacataaagagggagaatgtctttcatgacttcacatgaaatcatcaccaaaacacatgttcatgataaatatgacatcataattattaagttggataattaccatatcaattacccttttttaatcagagattgtgtaaatataagcttagcatgtattttgcaccatgaacacagttttgtttcataagaatcaacatatattaagaaaaatacactaaataccaaaaaaaaatgcataattattaattctaattagcagattctaatttgaaaaaaatattttaactatgcactattttagatctgatggacatctatcaccatcccaaatttgaagtcgatcggagtttcggttgcagagttcttaggaggggagggggg

SEQ ID NO: 109292 - DNA, 693 bp, Oryza sativa
atttaaaccatgccaatgcattctcagagcatcctatcatagaaagtttgttcagcaatacatcgtagttaacagaatcaaaggctttacgcatatcaataaacgctaccccacaaaatttactcctatcaacttcggttgcccagtcatcaaccatacacaatagagcactttcacatgaatgctttggtctaaagccaaattgactttcactgaagaaatcgctatttaataagtatgtctgtaaatgcttttgtacccatttctccaaaatttttgaaacaattgacaataaggatattggtcgataattttctatacataatcgatcaccgcccttaaaaatagggcgaattttggccaagcaccatgcttttggaaaatgcccttttgacaaagaaaggttgaaaatataaataagaccatctattacatttgtggcatatttcatcattttcaacattttaacagagatgtcatcaggccctgtcgctttttttacagaatggctatcaatttcttttacaacaaaatcgtaggtgattggaggagtatcaaaaatttgacgatcaacatgatcaaggtcctcacaattctcctgtggcaatggacaactgacaattacatctggaattgtggtttcactagctctccaacctgtttttcccaggagttctgaaacactatcaataa

SEQ ID NO: 109293 - DNA, 1172 bp, Oryza sativa
ttgtgaattcgggccattgtgtctggaagccggatttttaaaatcaaaagtcaagggtgccattttagacgccattttatactctgcatgattgtgttattatggacggctgtaagtgcgacatcacgcgtcatcacgtgttcttcattaaccaccatcccattcgtcttgcacgcagtgctttcgagtcctatctaggtcccttcctttaatccgattcctttaaaagttcgtagtcacattttctaggatcccatcaaggtcactgaattcttctttttccggaatccctcttgcctggtcgtcaaggcgccatttcgtctgaattttaaggtcattttgcctttctttcggcctacctatcgccactatcctaaatgctacagacttctaacaaattgctctggatagtccgggggaggctcgttcgtttgacaagtagaaacacgggcgtgaatgcatgcccatcgttctgatacgactgcagtactagttggtcaattgatttcgtgtgaccgcgtatttttctgtcctcgacaagtctccgattcattatccattactgactgcgtgcagtgcatattcggtatgtgagcctacattaaaccgaacgtgacaatatccaacatttgtaataagttcatgttttaagaagggcagaaaaaaaaatggcgaaagtttaaaataaattggagaaataataagaaagttatgaatgcttggcaatatgtaatcaatacatttgtgcaaatctcaatttgacaatttgttcaaacatctgattggtgcccattttgaataatgattaattctccttgtcactttggttgtaaatgcctcttaaaaagttcctctacctctatgaaccaatgtcgcttacaaatggtgcccttttacggtcacctaaagggctgtaggacaattaccccccggataattaccccctcggaaggtacccccccccggaaaaccactccaaggacaattacctccctgaaaaatgaccccctaggaaaatgaccccccccccccccgacgacaattaccccccgaaaccaacttattattagggtgaacttcccctttaataacgaagtgtgccccttttaaaatgtattatggtcgttttcaaagctatcaagcgtcccttctttaggccgaggtaatcaagg

SEQ ID NO: 109294 - DNA, 592 bp, Oryza sativa
tatcatgcttggtgtataaatgtgtaagtggggtagcaccatcccagttaagtagtaaatttgttctaaatgacaatgtctcgacacgtgtaacacgaagcaccaacaggttgttattacgtatccctcaatgcaaaactcaattttatcggaggacatttgtaccagttagtgtaaatgaatggaactgtttgtccgatgaatgccgatctgcccagtccttagccattttcaaaaaatgtatcaaacctggcaataaatagctttttttaatgaaggtggaggagggggttgcagtgaggtcaaattcatcttatgcttgattttaatgtaatttttagtttgtaacaggtggtaaacaggtgtgtgtgtgtgtgttagctttcgttacccctgtcatttctatatataatattgttcattgtcattttatgttgttttttaaacagagccctgttgtaaaccagcctattttaatgtttttaacaatgttttgtaatgatttttagctgaacatgttactctgtataaagatgcgaaataaataaaataaataaataaataaatgccgtcgaggaaaatgaccttttgc

SEQ ID NO: 109295 - DNA, 919 bp, Oryza sativa
ctaggattcaaggaacctgatgtgtaggctagttatcacaagtgttgtctgtgctaccaaattaaattgtgacagcatctttgacagggatattgacctcttaaacaatctgtagtaacatcatcatgctcatatagtcttgactgaattgacccaagtttaattacccaaggcagagggatctaaggatcgaagttaatttagtctgtttgcccattgcgtctgcaatgggttttcatttggtcccaaagactgatgactttcaattaaatctttggttttttttctattaattacatgtaaccgcatgtatagtcttttttttttttaaaaaaaaaacttacatgtctagttatgaatctttagagaagcactttttaaattttgtatgtttaaatttgacaagtttaagctaggctaaaactatgtctatattcagtttttttaccaatatatcaatattcagttatgtagaaatatcttcaggatgtcaatattctgaattacacagacatggttttagatgtaatatccaggaagtgaagagctgaattcacctacaagctgggagttctttgatatgccaaagtgatatctgaatcagcaggcatcagggatgcagtattgtgctgcatacatgcccactgaaacccattagctctccagattgatgattttcagagttcagagtgctgaaaatatacactttgattttttaccccagtggagcaggcagagagagcaacaatattatcataatctagagagagagagagagagagagagagagtagggacgttacagtagtatatatttagttgaaaatatgaatcacagcattatatatctgattaatatctcatatatctgcatctgcagtgcacataaggatataagatttgcagtttacctagtagta

SEQ ID NO: 109296 - DNA, 3114 bp, Oryza sativa
tcgacttgaagtagaagaaagtatattatttttatagtaatatatgcattaggatggtggccaattgatggatgtttttatttctttaaagaatttttaacaacttcttattattcccctcgaatataactagttttactttggttattactatataagcatacaaaccattattcatgtaattacacagttagttagttcataaatattaataatggtttggaattagtttcttaagtgtttatttgttttccttcaaagtaaactagatgggtagcactagcatccatgcaaaattatgttttttttacagatgattttcttaaattttgttaaacagtcatcttgttgtcttaccatattaaaagaaattgaatatcgggtttctagttttacagttttaaaagtcacaccagtcgccacctatgactcctttgtcgccccattatttacatgtccaacatgtcatggcttctattcattcctcctagagacctttaaaaattgtaccttgtagcttttagaattcattgctatgacaggttcccattttattgtttttagaagccccatcaaacgctgccactgtgctttttttatggccagcccgctactcacctctttattgtcattgagattagaaaaatcaaacatgatcatcgttgggattccttttcttacttttagaagtttcatcaatcgcactgatcctactgctttactacctgccaaccgcctttctagattgtatttctacttgaactcattttttctgtttttggaattttttttattttgaatagtattagttaaactcatgttgtgttctacgtggagtgctttttttaatatttcttatttttattccgaatatcagttatttataaattgtaatcctatttgaactattgattttatttttgtaatttttgaatttatttcattatctatttcaaattttaagttgatcacgttttgtgttgtagatgatctcaccttttaatattcattttttattctgaattttagttatttctaaattgtattcagtactatggaacccatctttagtcccgatttgtaaccccctttagtcccaagttacaaactgggaagcacaaagcgggactaaagacgctcatctttagtcccggttaaaataactgagattaaagatcatttttatctttagtctcagttggtgttatcaatcgagactaaagtgatgatctttagtctaagttgataacaacaaccaggactaaagatgctcggcgacctgacacggcctgacaaaaagtcatttgagtcattcttggtaacaccaaccaggactaaatatcatgaagtcctgttggagtttttatttgaggctaaagatattctttagtcctagttcctattcgaatcgggactaaagtgatttctctagtagtaactcctactagaaattttatttttatttttctgatttcagagtttatttttttattctaaattttaattattctcgatttatgttctagatgatggtttttttttgcaatattccttttatttttattccaaattttagttatttttaattttttttcatgattaaactatctttttctttttttcctaattttggaatttactttattttttattctcaattttaattattctcatataggataatattcattacttttaaaagtaattccaaattcagttatttctaaattatattccttgctgaattctctttttctaattttcaaatttattttatttcaaattttaattaaactcatgttgtgttcaagatggactgtcgtttcaattttcctttttttatacttgaactctctgttttgttttttaactttagtatttattttattttttattccaaattttaactaatctcgtattgagttctatacagactcttctttcaatactacttatttttaatttcaaattttggttatttctaaattataatcctacttgaacttttttttccgattagtgttggaatttctagtcttcaaagtgaacgtagtttcttctttcaaggttttcttaataatataatatatttgaaataagacaacaactatatacatttaatagtatcaagattgtaattttgtcgtgtgagttctaaacaatgagttaagtatgattatgatttgcgtctccagaattgatcgatgagtccaagtcaccatatcattgctcatagtctggaagccaattgttgtctgattggttgctcaatagcatcctccactctcactcctcagcccccttttgtttcaccttaaccttggtggcttggctttgttcgtttatatgggttgggaaccatctcgtacgcacgaaaaacgaaacggttcattagcgcgtgattaattatatattagctatttttataaaaaaggatcaatatgattttttaaacaactttcgtttaaaagtttttgttgtaaaaaatgcaccgtttagcagtttgaaaagcgtgcgcacggaacacgatggagagaggttgagaacactgagcaaagaacacagctagacttttaagataacattttagcttttatgtttctaaaccggttgcttttaagccctttaatttgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgccgggccgggccgggccggcggcgcgcgtgcacgacgtacgcgtcgaatggtccgaaaaattggctcctcacccttgcgcagatgcagcctccttttgcagttttgttttgctgcaaattcggattcgttttgttttggatccggataagttacgcgcgacttatccggttcggttacgcgcagtagagatcgtgcgggcgccctgatcaagcgacccttctctatataaaccgacccgccgtcttcacgcaatatatgcgaaa

SEQ ID NO: 109297 - DNA, 1173 bp, Oryza sativa
caaatactactgctgttcttcccatatgtatacaaacgtacatgattgtgaaaacaaaacgataaaatttcctaatcttcgctagaagaaaacaaatacacatgtatacataaaaaagacagagaatttatatatgcattcataaaaatcaatggtctttttaaaatatgattttctacaatataaagataaaatatattacttcacaaatatcaatatgtttagttaaactaagatctataataaatatttaatcaatgttcctttaaaccatcttctaaatcaatctattatatactaaaagtacattaaactttgtacaaacgcttttatatcgctatatggcactcaaataaattagagaaatcattgaaatcttttatatactaaaagtctattatatatctgcaaacgctcctacattgtcacgtggcgctctaataaaattagagaaatccaaaatatttagagtaaaaaaacaaaagcatccaaccttatatttttcacttaaattagtagacccgttattttaagcattggattagagctcttaaaattcccatgccgctaatctctatctcagaaaaaaaaacataaagtgcttatgtcgtacgatcgcctccctccccaaaaaacaaaacttaaatacctggaccatatacgatcgaaaaaacagttaaagccaaaaaaataaaaaagaaaacatgcactagaatcagaaagaaatactaataaggaaaaatcatcagtgtcggcactgatttgttgtcaacagcctttaatctatgattttattaaaataatactacacagttaaacttaatcataaagtgataaatatatcattacaaatgacaccagcatgtaatagcaaatgcgataataatgtttcaaataatttcatatcatattttatggtgccaaatatcacaaatataaagcgttaacttgaatctacatatgtaataattaaaataacaaaacctagcattttttaagtacatctatttaggtttatttaattttagagagattgagattctcaaagtatttggaattttttcaaaacttttcttatttgagctgtgagaagcataattaatagattgatgagaaacattaaattaaattttagccagtgataataaaacaacataatgggctgcaggaatt

SEQ ID NO: 109298 - DNA, 693 bp, Oryza sativa
tgatttttggagaaaaacaattttggtaggaaaagaaatttcaaaggcaattttgaatttgatttgaaaatttaaaaactgagtttagggaaaaattttgggattttaaactagattttgaattagaatttcaaaggaattctgtgagcaacttaggagggatacaccgattttataattcgaaactagtgattttcatttcgatggtaatttttggatcgagattgggatggtcatagggagagatttaattgagatctttggcacaagcactaagacacactaaataactgaatttgttgaattaggtttttattaatcatactatcaaatcatatacagatttattttccattataaaccaaattaattccctccattttgataaattcgaggtactattttatcaaaagtaccatgagttacctccaactgtttatatgtgaaatagtgctacctagcatgcaagaaacatgactgtgagacaagaaactaaggtaaaaattgttatagaaatttaagaaagcaaagttaattgtggttgttttactctgcatttggagaatcctatctatcaaattatgtgcaagatttcttatgtgtgcttgacagaggttgccagttgccaatgcaatcaatacctgccttgtatttgcctcgacgaggactctaatatgtggttcttataatatg

SEQ ID NO: 109299 - DNA, 689 bp, Oryza sativa
gttgagggaccttcggggacctttttccttcaccggccggccacgccggacaagctacaggtgcggcatgggctgtaaagcgcatggagaggcccaactctctaacagttacgaataaattactttgagtttggtcgaagtcggttatagacaaatataataatatttatattactaaattaattttattaaattaataattaaatatgtttttataataaattaatcttaggtcgaaagtattactatttattttataaactttattatacttgaagcagtttgattttaaccaaagttaaaacattttataacttgaaacggagggtgtaatgtatttgttgattatcactggattttcaaagaaaaaggaaatcaattcattattctattatccatcaagaaattaaaacgaaagcagtcagcagcttagtcaaagggaaacgtacaaactaatgtccaatttttgaatcaatccaactcagaaataaccacacacttggcattaatcaaagggaaacaatcagaagcagcagacacagaaaggtagcgaacacaaagagccagccaacaaagccatgcaaagaaattaaacacgcattaaccagcacttaaataaacttaaacagcagatgaagaagccgcagtctcgttgtcggcggcggcggcggcgggcgtggagacgatga

SEQ ID NO: 109300 - DNA, 736 bp, Oryza sativa
  unsure (1)..(736): unsure at all n locations
ttgtcatgattatagaggggagcgtcaggatctccgaatccccatgatgttcctgtgacttccatgtcgctcgccctagctgtgccagcctgtgcgcgcgggggctccccggccgcttctcgcttgtgttgccgccgccagcgaggccgccggtgatggtagtgctggcgacggcggcggctccctacctcttcccgtctccttcttcatcctttctcttctctccctccctccttttctccagatctggggtgtccggcggcttgcctcctccacccagcgccagtggccttcgtcctcgggctagcggcgtctcctctcccggttcgacgacgagggccgcgcggggaaccggnntcggatctggccgcgtaggcccagatccggcacctctcctgcagctccgcaggtcctggcgtgaggccagtgcaaaccgacggtggtggagttcgggtggcgccggcaagctccgccggtccggcgtggtggctgagcaggtcgtcaacaatgtgcaggtggttgtgtgcatataacagataccttcgatgtgcaagtggcatttggtggcttccattgcggttactttgtttggatgagactccaaggtgaaagccttactcggcttgctgatgctaacaacggtgacgctctcatgcaccgttcaccttcttgaaggcattgctattggagccctcattcaactccacatcaaggggtttctccgggtgaaaatcct

SEQ ID NO: 109301 - DNA, 719 bp, Oryza sativa
aaccctagaacccctttttattggtgaggacacggagaacacactccgcaatgttttagaggtaaaatttatttagcactttgcattacttgagttatgcctaacaaacttcttttttttttgaaatgcagaaagttcgtcaaaggtgccggaaacttgtagcaagattaggttgcaggtcggttggattggacgacgtgtaccaaccgtggagactaccaccaccactacctcaatccgcgcgtccaagtactgctcgacactccatcaggatagaagagcgtgaagaagttggtggctcatcatcgtcacgcattccgcaagggaggggaaaggggaaggcgccggctccacctagcgacgacgatgacgatgacgacgacgacgacgaggatgaggactacgtcgcaccagacactgaggagatagacatgtcgtagcttcccgacgcacctcaggggacgcaacccacgcaatacaacttgcgatctactcgggcagcgaaaaagaggtaaaatgagcttaccattctaaaatgttatttgatttccctcattttgtttttaatatgttttaaacattgtattttcaaatgtaggtacactccgggctcgcaagcaattcggcgccaatggaagaagtgatttgtatgaagttaatctatttgttggtagtatgacatatgtggtgcactatgtgatataaaaggtgatggacta

SEQ ID NO: 109302 - DNA, 564 bp, Oryza sativa
tcaaattcagttcaaacttgctttgaattagttagtaaagtagttaatgttaatacctaagtaattgaaaaagattcatactcatttgaattgggtatatactcaatttcaacaatggtgcccgggcaccatggagcaccaaacaaatttactatatatatatatatatatatatatatatatatttaatatcatcataaaattaaagttgcgactgctcaattaatagcaagccaatgaagaacataaaatgttgtattttcttctccaatccaagccaaataaaaaatattacagggcaaatggacaattaacaaatccagatctctataatacgaaactctcaaatgtatacgtacattaactgtcaacatctatttcgctggtggaaaaccatgcaagcagatggccaggtcattctttttgggtgcaaagaggatcgttgctcatggctgcgaaaacctcccatgcttgttcatttacgtgctagtgacagaatcagaattgttaaccagcgaacaagtgatatccggcccttcgcatctcacttttccaatgtcaaat

SEQ ID NO: 109303 - DNA, 5521 bp, Oryza sativa
  unsure (1)..(5521): unsure at all n locations
gtatccccatctgaggtgcatgagcacctctctcaacagctgccatgagggcttctggcaaagaggagtcagggagtgctttcttccagaaacagattgccggactagcgccggtgctggggttgccatgggcaacccttgcagcgagcaacaccacaatgaaaagatgcatgcttatcgatggtgtgtgggatttgatgagaggtgatggaggtcttgcgtttatatagcctcaagggaggttgtgggtgcaggtgatccttagcgatcatattagatcctagcttacacctccttgtcacccagtaggactaaaataattaaaggcctgcagctcaaccgtcatacttccggtatttgataatcagaaaataaagtgttggtactgtaccactgagttggcatccttatgtattgatataaaaaatgtataagtggccagctagctattgcgaaaaaataagtagatatatacaagtcattatatagctagtagtcttgttcctaacaccctattcctgctagagtttttgtgactggccgtcatagtagtgtacttctcattattatttttttaagtgatccgtgcaagacagtgcgaagtttcatattgttataccagaaaaaattataagattataatcctgaaagagacaaacaaacacacaccacctttccttgctactagcttctcacacgatgtcaaaaacaaatgaataggcacttgtacaaaaccggccactgctaagcatgaccgatcaccgcaagacctacctagctagccggctgtcgtccaagtgctgtctcctggctagcccctacaacctaacaagtcggcaccgctgcctccaactttggactgccctttgcgcctcctgccttccgtgctgcgccgtcgagggaggccttgccaagcaccatcggggaggcctagccacaggttgtccaggccgcgggagaagccacagacgcctgctgcaacactctacctgccttccggcactgccggtcaggttctgtccgccagaacaactcccgtgtcgcttggatgtgctcgagctggctacacatctatcactgccccgactttcactagtgagccaccgccttccccgtcgcagcatcgtgttgtcgtcccgaaatccttgacatctcgcatgaaccctagaggcggtggtagtggtgtggtggcaggggtgcaacggcagggattgcctcccatgtcgccgcagccctaggttcgacacgggagcttggctaaataattggtagatacccctgattgattattttcacttaatccagatggttctacgccgtcaggaaaacccattttcttgtaatgaagaagcaagcagtgttgcattagaatnnnnnnnnnnnnnnnnnnnnnnnnnnaatacgttatttgacattggaaaagtgagatgcgaagggccggatatcacttgttcgctggttaacaattctgattctgtcactagcacgtaaatgaacaagcatgggaggttttcgcagccatgagcaacgatcctctttgcacccaaaaagaatgacctggccatctgcttgcatggttttccaccagcgaaatagatgttgacagttaatgtacgtatacatttgagagtttcgtattatagagatctggatttgttaattgtccatttgccctgtaatattttttatttggcttggattggagaagaaaatacaacattttatgttcttcattggcttgctattaattgagcagtcgcaactttaattttatgatgatattaaatatatatatatatatatatatatatatatatagtaaatttgtttggtgctccatggtgcccgggcaccattgttgaaattgagtatatacccaattcaaatgagtatgaatctttttcaattacttaggtattaacattaactactttactaactaattcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattattataactaggtatatactcacaatttgaaattttgaaaattttgagtgattttatacattagataccatggtgcccgggcaccatggtgccccatatgagtgtcctatatatatatatatatatatatatatatatatatatatatatatatatatatatatatatatatatgacgaggtaactattgcacacaaaagatgtgtatatatagtagtcttactcataacacgatctttctattaaacctatcgtgacattgtctattgtactcgtgatgttttttcacttaatcccgatgttttcccgccatgagcaaaactgttttcgcgtagtgatgcagggagtgtttcatgttagaatatattatgtcaccgatgatgaaactagcagatacgatcgatatttagcattggaagagcaagatgttttcggttagtgatacaaggtttcgatttgagtttcaaagttgagaaaataaagtatatacatttatgaagcaaacaggggccgatcgatctagcatgggggtggcggggtctcaagccctcactattggcgtgaggaccatggagcccgcacgaagccctcgctaaaattgtttgctctatgcagatttaaagagagctatagctttgtttagtttgtttagatccgtcgctggaagcaaatagtgttgcgtcagaatagattatatatgcaaccgatgatgaaaattatgttatttgacattggaaaaggggatatgcagaggcctggatatcacttgtttgctggttggccaatcgatcagattctgtcactagcacgtaaatgaacaggcatggcagctttcgaagccatgagcaaggatcatctttgcacctaaaaaaagacctggccatatgcatgcatggttttccaccagaaatagatgttgacaattaatgtacgtatacatttgagagtcttgtatcatagagatctggatttattgtccatttggcttggattggacaagaaaatacaacgttgttttatgtgcttcattggcttgctattaattaaggagtagcatccttaattttatgatgatattaaataggtctatatctctgctattataaaaattaaagaaatatagatctgtgtttgagtatgtcatccgtgtttgagtcggtttttaagttcgttcgcttttagaaatatagatccgtgtttgagttggattttaagttcatttgttttttggaaatacaaaagagtcgtataagaaatctttttaaataaactcgcatgctaacttgagatgaaatatagacttctaattgaagcctatgattttcttaaaaaaaatatccaagcgaattccccctagctaaaccatataacaacagcaaaattaaaatggtatttacccgttgcaacgcgtggtattgtttctagtgtaccccctcccacctcccatccgtccccacctccctccctcccacgccccctcttcctctctccctcccgtcctcccgcgtcccctctccctcctcccatcgctcctcccctcccatcactcttcctctctctccctcctcccctcccatcgctcttctttctccctccgtcctcccacgccccctctccctcctcccgtcgctcctctctccttttcttctttttttttctctccctccttcttctcttttttaaaaaaattaaaaataaattggtgaattcaagacttgaacccatgatctcatggttcatggcgagcacttctaaccaaatcaccatatgatgatttgttaacaaatcaattatgtacctgtaataatcataccttgttactatgattcgacagtaacattatcgcagaagggtagtaacatcatatgttactgcaaaaatgtataggttgttactgtaaactttataggttgttactgcactttcagcagtaacagagaacatgcatagtaacagtggccctatagtagtaatgttttttagatctagagtattttaaatatcaatctttagagagtactaacgtacatgtcatgtcttatttttctaactcatttgcatcatggcgttcataaaaaaaaagttcttaacgaaactagaaccataataactactttttaacgttgttactgcgaaaaacagacgtgttactgcatattagccgtcgtgttaatacgctgttccagtgagacgaggactaaaaaagagataaatctcaatctttagagagcaatatctctcacatcatatcttgtatttccaatccgtttgcaccatgaagttcataaaaaaacgcttaacgaaactagatccatcatggctactttttgacgttgttactgcgataatgttgtcttgttactgcaagatgaccgtcctgttactgcacgattcctgcaagacgagagcagcaaagtggtgggtaggggagggagtggtgggcgggtttgaccggcgggaggacactttgaccaaggtgggaaaggggttttgggccctagggagggtggggaaggtgggattggcccatgggaggggggtttacaatagttattctaggggaggggtgtacaatagattcactatatatatatatatatatatatatatatatatatatatatatatatacactagcaaaagtgcccgtgcgttgcaccgggtgattacggagtgtgtatattgaccaaaattgttgtttagtttagcaaaagtgcccgtgcgttgcactgggaagcgcacagatcagtaaaaatatgcaaattaattaaaatacaaattcgctgaaatatttagtatttttaagtaggtatgtgtataattaaataaatttacaagtaaagcaagtgcgagaaataaaatgacattgttaaatttaattttattaaattctccatgattagttacgctctttggaattttattggaattttcagaacttaattgctaattttaataatacaaatatcatttaataattatttaattggaaaaagaaagaaaatccttccttttaggtttgcttagaaataaacacatttaataactataattataaatgcttctgaaaaaatgaagcactaacttctcttttttttttcggcctgagggacctaatacagacttatttctggcctgagggacctaaaatagacttatttccgtcccttccggtcggcccacggccttatcaaaaccctaaccctccccacccctcccccccgccccctccccaactcattctcctccctctcccaccgcgagtcggcgagtggcggcggcggcggcggtagcgaccggcgatctcgcggccgaggcgaggcggcggcatacctgccctaccgcgggcaacgactggtggcgggggaggcgggcgactggggggagggggagaggcgggagaggaggggagggggca

SEQ ID NO: 109304 - DNA, 523 bp, Oryza sativa
ctgcagcgccatgcatatgtataatcgtgcgcttttcctgacataccgtgcagaccgctgcatctgctatttaaaacttgaatgtgtggctagtaagaaacttgaatgtggataaaattgccattgcgacatgtaaccattcatggagtgtatactgctttatatgtagctatgactcccttttgctacaactattgaattattgggaggataatagtttacagttatactgaaaaaggatggatcgatatattgtcaacactgtgtatatctaagtagggaagatatctagaaatagcctgacaatctatctatttatgggttatatcaccctttttctatagattaagcatatacagggaatgaatgctaccacatatggaataatgaaactattggccgaatatctaatggatccccgaggttatcagactataacagaatacaaaatgcatgatgaatcacgaacgatccgtcatggtactgcatggacagaacctacctatacaccaatactttccat

SEQ ID NO: 109305 - DNA, 610 bp, Oryza sativa
tgtttaccgggactagatttttgcccatgtatcctttcgtttcatggattaagacacaattattgcctcttgagaaaggggtcactgcttagcagtgttgctgccagttgaggtgtactacttcagttaagaagtaacttagttccccaaatttttttcttaaaaacattatatcgaatctttggatatatgcataaagcattaaatatagataaatggaaaaaactaattgcacagttaggaaggaaatcacgagacgaatcttttgagctctaattagtccatggattagccatagaggtgctacagtaacccacatgtgctaatgacgggttaattaggctcaaaagattcgtctcgctgtttccaggtgatttatgaaattagtttttttattcgtgtccaaaaaacccttccgacatccggtcaaacattcgatgtgacatccaaaaattttcttttcgtgaactaaacaaccccttacattcactttggagaaacaagtgacatctccaacttgtctgtactactgttaccttgactgatagggaatttctgtctagtagtaccagatgtaaactgatcctaattactctatacatttatgtgt

SEQ ID NO: 109306 - DNA, 501 bp, Oryza sativa
gcgagaggaggcttggagcctcatgagcgcttgcagcctctgcagagtcgtcgctgcttgcttcctcacaaggtagccacgtaccagagcttgtatcttgacaagcgccttgagagcgcgcaatgccctcctagcctgcatttgcggtggaaaattcaaatttttacagttgcttcgaaaagcaaatcaacagaaacaatatggaagtttttgaactatatgccatgacgactaggcttgtgtccccactgtgcagttacctaagcgtttgcagcaaatcatcactaaacaaaaatatcctaaaatgtggaatttatctatagtaggaagcagattaaacaatgtgcattgtgcaatggctagctactcaacggcaagaaactatcaaacaactgctgccattaacaacagttagtaaagtgaagtcaaatctcctgtccaatataaaaccaggagaatccataccacctactccctccgtcccattttgagtttttgctt

SEQ ID NO: 109307 - DNA, 709 bp, Oryza sativa
agcagtgacgcacgcccaccccacccgcgatggtagcagctcggctaaccccttccacactccacaccagcgcaacgacggaagtgtgtgacgcggatggatgtggtagtacgctgtagcatgtactccctccctccgttcttaaaaaaaagacaaaccatgttttcgtgtccaacgtaaattaaaaagacaagtcacgtataaaatattaatcatattttatcatctaacaacaataaaaatataaattataaaaaaatttcatataagagagacagttaaaattggcaaaaaaaacccagagtttgtctcttttttttttatggagggagcacgagcgctcactgatccggtcaaataaatgtttgtgcctttgtttatcgccttgtgtagggatacggattctaggcctctggaccacagtgggaacgtccgaacgtgaattggttaaggctgtgtttagttcacgctaaaattgaaagtttagtcgaaattgtaacgatgtaataaaaaatttaaaaatttatgtgtgcaggaaagttttgatgtgataaaaaagttaaaagttcaaagaaaaattttagatctaaacacggcctaaccatcgttggcatggaagttgaaccgctcgtatactgtatacttcgactctgtaatgtgtatagtgttataactcacggcaacaagcttgagaaaatggggctgcagg

SEQ ID NO: 109308 - DNA, 619 bp, Oryza sativa
tttgagggatcatgaatgggagacggtgatccaacttttaagcaacaatcaaaaacataccatgccccttattgaacaggcatggcagatggcatcactcttgatcggtttaattgtcggcccatcttgactggtgggctaatctatctataccttaatagttacacgctcgcgcatatatacatatatatacatatatacatatatacatacatatacatatacatatatatatgtatatacatatacatacatatacatatacatatatatatgtatatacatatacatacatatatatatatatacatatacatatatatatatacatatatacatatatatatatacatatatatgtatatatatatattgagggaatggttagttcatatctaataattggatggttacaaccaaatacttctacatagaatgccaaaaaaaaagtacttctacataataaaatttaaacgctagacatcctaaaatattttgaaacatagtgagtaatattaaaaacaaactggtaggaaatcattagctcactgaaacaagccatcgatcaaaacctcgcctcctagtcctacacccatggtctcttgatcgaggtgttcat

SEQ ID NO: 109309 - DNA, 612 bp, Oryza sativa
tgtgcaataaaagatatcttgttgattttgttttggagtgttttcttgttaattggatcacgccgcaccgcacttgtccgtgttggcctcccaaaaatccgttataaattatcttttatctttagaaaaatcactcacctcaaaagataatttataaccaaaagaccaaaaaccaatcgcacaattgtcaagccaaccaccccagatctacttacgacaaacacccaatccaggccgtccattcccaaacaagagcggatctgagccgtacaaatcctgagtgcggatccgcttatggcgcaaaggcgaagggtactcgaggctaccggttaaaacgcccaagtcagtggctctcgtcctcctttctcctacgcggccggagagaggaggggggaagagaggatctcgcagagcgccatagcctcggatccagaagcggaattcggtggaggtctcgggcacctggatcgatcggaggaagggaaggcggagcaacggtgatggggaaggccgcggcggtggggacggcggtggtggtggccgcggcggtcggggtggcggtggtgctggcgcggaggcggaggaggagggaccttgagctggtggagggag

SEQ ID NO: 109310 - DNA, 644 bp, Oryza sativa
tgttcacataaacctttagtacaaaacttccctatgttatgattgggcctattcagctgcaaggtgtagacactaaaacacagttttgttgccacggttgcttacacggagcattgtttccagacggctgtatcgcagccgaaccagcccattcatcctctttggtgcttttgtttgccttttctctctctgcccatggcgagttaacaagctccattcccttgttttccttcttagcactaaactccacaactactgtcatttcaattttccttcaatggtccaaacgatcatatgtgaaagcgtgtatggatagaagatgtgttgtaatattttgtggattaatgtatcgaaccttgagggagtacatggtttagatcttaaggagccctgatagattcaatgacaactaatcatatcctatcataacaattgaatccaatagagttatctatactctaacaaagctgctctaacaatatatcagggagaaagcaaaatgagagaagaagatgctatggactataaagcatggtttgtaaaacttgcgcggttatcatgattatcacgtacggtgatcttctcggttcttgaatccgcgataatctttgtggtaaccgtacggtttttcacgacaatcatat

SEQ ID NO: 109311 - DNA, 579 bp, Oryza sativa
tagttcatggacaagcgtttacattttacaaccgttgcagggacgccagaaatcgtcctcgtgctcccggtacccgcgcgcaaacttccccgggcttggatggacgacgtcggagtaggagaagcacatcttgcagacgctcgccgcctccagatgcccgcacgggaactccccgaccaccttcttcttcagccatggatgcttcacgtggaggccgcggttgcaggtcctgcagacgcagtcccacctgccgctccggcggcgccgggtcgcccaccggcggcagagcgggactctcgccaggaggccgccgccgtccggctcgtcagccatcgggacgcacgtgacgacgccgaggaagtccttgctggacatgtgctcgaagaagaagagcgtccgcggccgggagggcaggaacaacgacgcgaggcagccggagcggcggcgagccacgaagttgccgtgcgtccaggtggtggagttgcatggcgcgctgcacagcgtcacgtcgcccggcgcgaggtcgtgctcgtcgcccgggtgcagggcgttgtagtgatccaggcactcccgcgcgag

SEQ ID NO: 109312 - DNA, 689 bp, Oryza sativa
tgggagttcaggtacatcaggcttctggaagttctccttcagcttgtgttcgaaactgtcatatttgcttccattgagaaaaggataaacttaatataaaaacctgagaactatgccagttaggaaagttaagctactttcttgaagactgaagggagaaaaactaaggccatatagtttttatagggtaatgttagttagctttttatagattcttgacactctaaattagatttagtgataaaattattatcacatacatagtctttttgaaagatacaattgtgtgcagttaaaaacttaagatttcaaattaagtttacctacagcatatgctcaaaatatagaaaatctaatcatgttcattttcacccaacaaaccgaccttgcgatgtgtggctctccttctccaagcaatgtttttctaaacaaagttaggtggtttgttggaaaaaggcaggattattttttcctagacaaatgggtaattgcactaggcatacactttcctaaaaaggcaataaaattcaaacaccctgtaaaagtccatcagtgccagttccgtcaaatgacaacatggagatctcacaagaaactgagctgaggcttacctagaacagctgcctttcaattgctgcatgtgtgtgtcccatctggcgaagtctttcggatgcttctcactgtgtgat

SEQ ID NO: 109313 - DNA, 588 bp, Oryza sativa
ccctgccagtgtcagcgagccgggattcctcacaggctcggcgacgctgccgtttggtccgccttcgccgccattatggccgtagcttaacctttagccttgattacactctgctcgcgagtgtggactactacgttgctgctgctgctgcctccggccattacacaccaaaagcgtgcggttcgtgcaggactagatttcgttctggcgagaacggagcgtgtaccactgcatgaggagtaaatttgtttacgtaccacggcgccagcaaagtactcgatcgctagctacacggtgaccacataattgctctcggcgagaggatctccgtgcaggcaagcgtggattcgaaaaaccgatcgacacggcgccagcacttgtacgagagtacgcggttgccacggagtgccgtccaaccaccagcgacaaaagttggcatctagggaatgactagcgctatactactgtatactactacggccactagcagtgcaatgcatacttttgaggaggcttcaagtaccacataatattaagctacaagtctcaaatgtatgggttaattagatccatgccattgtaaataaa

SEQ ID NO: 109314 - DNA, 712 bp, Oryza sativa
caactgtcgtcttctggttagtgatatcttgccccaaatgttcatctagaacattttacaggtgttgtcatacgctgtctcgtgttgtccattctcgtggagtagaaaattgtagtagtggacaattttcaacttcaatgtccaaagaaagaacatagttgagctgtcaattcttatttacctgtagaatctgatggatcataaacagaaaaagtatccttacactgctgaaatgcttgataagagttactaaaaaaacaagagcaaggcgacagtgctactgcctttttccagaacaaaattatcagtacatctgatatctcttagttatataatatctggacagaattattaaattcttctctaatatattttactaattaactatgttgtcatgagtcatgagtaatatctcgtgacaaacaaatgaacaattgtgcatagcaatactgctagtaatcagaaccctagacgttgtgcaattggcttgggtgacttgggaccatgtagttttgctaatgatgcagctatgctgttagtctttttgtatacgaaatatttatgctctgtatgcatggttatcattagggcctgttcactttgatgccatgggcaaccttaccaaattttggtaaagttaccaaaaaaagtggctacatttagtttcctgccaaattttaatactatataagaaattctccacaattttggt

SEQ ID NO: 109315 - DNA, 586 bp, Oryza sativa
aaccatagtgagcaacaataaaagcctcgacggaagcaattacgcaccatgccctccaccttgaaaaagacgtggttataaggcatgagtcgaatgtttcatctgccatgagatgagacactattcatggtactgccctcagaaagtcaagtcaaagcaagttcaaccaacaacaagccttcccaacgtatctggaccaaaaagttcaaagccaccaaacagtggttctgcctcgttgacctcaccgcctattggacaaagccttctgaaccatgtgcaagtagaaacaaagggaaaagttttgaatctcgagcaagttgaaagagcagatgaagaacagattccacatgcaagatcagagccacagtaaaagggagactgctaagtgagtcagagtaccagaccgttttgtggcaagtatgcagtctcgagataaagaaagacccgcagagtatgaagctaagaagaagtttgaagttccccttttggtttcatgtgtgtggtccaccgtcgaatctcggggtcgagattcttgtaaggggggtggatctgtaacgctccgcttttcgtgagacgttaaaaacta

SEQ ID NO: 109316 - DNA, 857 bp, Oryza sativa
ctgcagccccgaatgccatttttcttgttgcaacaacaatctgactaagacagaagctgtagccttaaaagaaaattttcaacaacatgtctacaccttttgagcggcagaaattgtgtgctttgttggccaagagtgacagccatggcggccaaccgtgaagctacgcagaaataggagcaaggaaacagaggaagaagaaaggaactggggggacgattttggatcgtcggatgataacgaacggtggatagagcagaactgcacgcctgtgactttgcaacccaaagtcagaggatccgcttccccagatgagccacgcccatgcgcacgcggcggagacgcaacggccaacggctcgtgcaacggcggatgctcgcggttttggggcggtgaaactcagggaaacccgctgagccgtagtacaaattcgacacgcaccggtgtcgtacaaatccgagagacacgatggtttccgcgcaagatgcacttccgcacgggcgcgctgccgaggatctcaattctaaaccgtatccagatgaattttactctgcttgttaccctatctatgtctgactaggttggatatacttatccatataaaggcgaaatgctatacgtatgacttgagcatctgacttctggacgactgcgtagtacacaacgtcagtaacaaatagaatatcttacaaagcctcacaccgtcacgcatcgcattgttcttataaaaggtaagtggaacccgttcaatattagatttgaagtcaatatccccaagccaataattcatcataactaaagtttaagttgcttttagaaaatttaggagtaactagcgacattattgactttcacat

SEQ ID NO: 109317 - DNA, 597 bp, Oryza sativa
  unsure (1)..(597): unsure at all n locations
acaaaagctaaagtgacttaaaatatggaaccgaaggaataatagcgagtaggaagacaaggaaattaatttgtgcagttcaagtcagaacgtagcaggcggagacgatggtttttacaggtgcaggtccagagagctcctggagattttattcaggtagtgcgccgggtaagggcacctgcttgcccccttgcaagttgtcaccgggagattttcggtcgcgtgtggcgacatggtctggcagcgaagattgcaaggaacccagattataatgactaaaaatctaccctattagctccgcctgcgtcgctcgccctaggcgacacgggcagcgacaacacgcgccgacagcccgcttcctccccctctcttccgccttgccgccgcccgagcagctgccggcaaagccacgcagcagcaaggatggtggcggcggggcctcttttcttctctcaaggagtacggcggggcaccggtgggacttgagcgactgaggcggcggcgcggtgccgccagatccgcgccgctccggccggatctggcgggatggcggctggcggcggngaaggtgatggcggcgggggtgatgatggcgtc

SEQ ID NO: 109318 - DNA, 1147 bp, Oryza sativa
tccgcagtagcaggattgttggggaactacttggatcgaaacgaacgcacagaacaaaaatcaatggtgcgaggaaattagagcggaagggttttaataccgtgctggcggaagctagggttagtggcggcggcttgggaatttctccgtcctcgacttatctctctctctctctctcttttttttattcgtcctcgactaatctcttcttgggcccttgctccgatccgcatcggaccgtgcaaagagggccacgttgtgttcgtttccgttctttttttttttttttgtattttggctctctgatctccctctcccggggtcccgccgctcgtccggcgaagccgacagccgcctcgccgtcgcggcctcgccatgagcctcttccccaccggagtcgccgcatctcctcgctgctctctcttccgctggaagcgcaagctccctaatcgtatttttccatggcctattggctctaccattccaccagagtgtagagttggggagcgcgaaagcagtgagatccgtcggcgatgagtgctcaccgcgggtgatgcagtcttccgccgccgccgtcgagatgcgccggaacccggaaggtaaccaccacaacacacccaagtccccacccctgtaccctgtttaggccttgtttagttccaaactttttctttaaacttccaacttttctatcacatcgaaactttcctacacacataaacttttaacttttccatcgcatcgttccaatttcaaccaaacttccaattttggcgtgaactagttttgcatctgtcgcgctggtgcagttggctagtgattagccaagcgaactgttcagatattgttttggagtttacgatgtcatgtgattatatccgcgtccacgctgattttgtcttcaatcgaacggaaatcggctgctaggagactcttatccattgatcggtacctgccaaaactctcacttgtgtggttgtgttgtgcaggcatcattgcacctttgtccccaatttggatgccactaggaaagaatggattggctgccaccacatcagacaaggaatcaaaacatcgaaaaggaggtagcgtatcctcagcttgggacccgtttagttcgcgaaaagaaaatttttgggtgtcacat

SEQ ID NO: 109319 - DNA, 693 bp, Oryza sativa
aattttaatagagcaagcatgatacaatgacatgactcaaaaaaaaaaagtaagctacatctcatagaagagttttatggattcagaccgacagcaaccatgaaaataagttccttgaacagaatggaatgaaagcccataaaccgcatcttgcaaatctgaacttctaatctgaaacgcgtccagtgcagagcaatcctttttcacttaataaagtgcgtttaaatatgtaactcataactatatgtaacaaaaactattttcacccttttcaaatcaaggttattggcaataaatactgcatacttttttttgagagacataatggtaattatttaaaagaaatatcatgattcctagctgcaagatatgcattgtagaatgaattgtagaatgaattgcacaaaccttgcagcagagccagccgccgtcgttttcacatatgtggagcctacacctcatggagcctttgcggagcacaaatttacatggccttcggcggcgcggcagttgctgccacattgggttcacatggccgtggccagtgcctagtgccccagccaccgctgccgccgtgttgatcccagatcgtcggtcctcgtccgccctgccctgccaccacattaggcccgcacgaccatcgccgacatcgctgccgccgcttggccgcagccctcgcgccgcgctccacat

SEQ ID NO: 109320 - DNA, 1553 bp, Oryza sativa
agttgtaatatcactgaactgaaactttcatatgacaaaaatggccattaatttgtatagatcagctgctgctgcagttacagtgcatctatatgtcatggtgctgtttggctggtgctttaatcagtttgttacatgctgaataaaatgtcatgatctttgtacatgctgtcaaagttgcaaattttagctacatgctgccaaaaaatttcatgatctgtgactctgtgtatgtgctgccatgatgaaattcctaagctgctggatttccaatttctttgttcccctactcaatttagaagaagtaagagttgtggtcaaagtgaaggagcgttctcagaataaatgtgctctactcttttttttttaatcaattagtttctctggttttgttttattcaattccaatattatggcatggcattgatagctcaggaacaacatcaatattcgactgaaactaactacaatatacttgctaaagtgcatatctgcagctaaaacaagcaaaaaagttttggatcttaacgaacaatcatgtaaatagcttatataactgctaaattttattcacataatgctaactaaatttaagttccaaatgccttgctatgttttctttttctttctttcttttttctattgcagattagtgtagcggcttcctgaccaaaggtgtaaagcatcactgctatcaaagtcatttgactgatatctgattgacgtcctcaacggttgacacatactcatcggtcaagtcctcaacgtacatggagttgaataagtttgttgcaatccattagcaaacaccaaatgcagagttagttttttggtggtacaagatggttatgcacatgagcaagagaggcagagagcaagtgaaggggcgcaagcaacgatgtatcacacaactcacactcactggtgctttgtccagcaccaaacctcagcaccagatttttgtgccaataatcacatcagcttgggagatgtcttcctgatgcggtgggcaaaggtatcgagggccatggaaccggttgatagcccgaggagcaagagggatttacaggaggtggaggacagggaacgcatcgcagacttgttctgtacatgtttattagatcattgtgacagagtgacatgttgcactatcaagtaccaatagttggttgggattggaatgatcaaaatgagttgttcatgttttagaaggctgtgtgtttctccattttagtttagatttgagaaggttctaggtttttcctttaaccttttcactctgtttctcgcccaacataactcagtttttctccttttcactctgtttaatttatcaatttctaaatagtgccacacggtccaatctccggtaaaactgtcagcttgagaaaagtgatgtggaggaaccatgaactcaatgtcttgctgcattgaactaatatgaataaaagggtaaagtttaaataatttcaggttttaaatagatactccctccgtttcacaatgtaagactttctagcattgtccacatacatatagatgttaatgaatct

SEQ ID NO: 109321 - DNA, 882 bp, Oryza sativa
tacgagttcgcgctttctccgcgcggcaatttcgcgtgcatggtgctttgtattctcgactccgagctccgaggccccacggtgttttgcattctctttcgttttcgtatctgtgacttattcagttcgtctcgagtctcgacgtctcatctcctccgagtaccaggctgccagccggctcatccaatttaatattttcattcatcgagcgaatagcaacttagcaagcaaccaacaagcaaggcactaggctgatcatgcaaaacaagagttaaaaaaatgtactattcttgatatatcgcatttgctctgcagtatatacattattttagggggcaatttcgtttttgcccccactttcatctctaaattgagtttgcccctactttttagagttttcatttttgcccccacttttttgaactgaaagatgcttttgcccctgttttggatggaggagttaacggtgttaaatatgacatttatgccctctcccaaatctattcattaattgtgtttttgcccctattatgcaatggctttgaatttttttttgtgaatatgtttaaaactaaatgacatatttggacattacaatttggacaaaatttgaatttgaagaaattttggcaaaatttcggcatcattttaacaaaaattgaacaaaatttcaacaacattttacacaatcatatgaagtcaaattgtacctcacaagtatcacaaagcatgacaacataataaccaacaccaatatagcaaagtttagttcataacaagcaccaacatagccaagttcacatcataaccaacataatatcacacattacaggttcaaatcatagccaacatagtaagaagtaattgtccagatcatgcatt

SEQ ID NO: 109322 - DNA, 1059 bp, Oryza sativa
tgttttgagctattccaaatagatctgagaatagattactttgtaccacacaaatacacgagaacacgaccacaaaactgtagatctggagaagacaattgggtgttgtacatcagttcatttactacagtacagtttctaagatgctagccagtaacaccaaccatctgctatggtgttttaactttcgtgatctatgtgtgtgccatatttttgacagtgtgctgcaattttgtaagaaacttccagtttccctcacgtattactctgaatttatccttgaaggagggatgtctacaatttcctcttggatatctgatgacaaatgaatgtgctgtcctattgatttttattgttgctaaatggctggcagagattgctgttgacaaatccaatattgacagtagtgattgacctgagtaaacagcccaaattagtgtcttttagaaattattgataacatggattctttcatttttctttctttacgagcttctaaaccatcataaggtaggcttgagagcagcaccaatcaataggttatacatggttcatggattttcagccacagcctattttgttgatcgttcaaatagttagtttttcgggggtgcttctggtgttatgtaagactgtaatgcctaacagaactcactatttggttcctgcctgctctgtggtcaaagattctgctttatctggttcagacattaaagttgaaacaaagaaattgctacatgttaacagcttcctttttcatctgtttcaactttcaagtttgttttaatttcttcttttgtaaatcatcgaattggtgtatgtgcgtcccttgggtgtcaggatggttggatgtattagaccttgaaaagtagtttacttattctttacgttattaggtgttcttttataatcttatgtgcgcccttatggcaagagtttctgggcctggctatcaacctatgcttctgcatctgctggacttgaaatgctccagttgaagcagttcttgaagaacacaaaggtgaagaggatgttccgatgcttcttctagcagtgtac

SEQ ID NO: 109323 - DNA, 1052 bp, Oryza sativa
aaagtcacaggaaaacttcaccataacaaagcggacatggcccagtgctaaaaactgctaaccaaattctccctaaatttcgaagaataagtgcatgaatcgacgacgattgttaaaatgaacttgtaatcgctgtgaacttgggcaccaatgtacacattgcagctggcatcgacgtcacaatattgtgcatccacatccgatccgctcgggtggtcgtgctttcggcggctgcttcactgaagaaagaagatagcggattgtaagtatctaactatagagtagttttattcggaacatatggaatagaagtaaagatacaatgcattctactaatgtaagaccattgtctgtagtgtacaatatgaatatcacgaagttgtttttctgaaaacaatgaacatgcactctgaattctcagaataatacccgttcactagatgaaatgcctcacagtaacagtactgatctctaacaagaagagggatttctcaaagggcttatcaaaagataagttatgcatattccaaatacttcatcctactacactagacagattaaatcatatcactgatgagtgatgaactaccaggaactcatcatgacgtcataatttgattacggagaacactccaagtttagtcaaattcgactctgccttccctatcaacctagaacatacccgctcaggactgactgcacttttgttcgagagtttgacccagcagcttgtgatgatcaacaaaggcatttaagtcttttttttttttaacaaaactatgcatcactacatcaagtaacatcatttaagtgcaatgataaaagctaatagtctccaatcacatgtggtctccttgattttgagggggggaaaagcactgcaagtttagtaaaatccaaaagttgctaatagcccccaacaatcaaccaacgtgtgccgtataagagaaagtgtacacatacagcatacaaataaactcccctattgctttaggagtgcgacagtaagaactacgaatgtcaggataagaaaaggaagggcacacagtaat

SEQ ID NO: 109324 - DNA, 683 bp, Oryza sativa
tagatgtaggttagacttcccgttcgagaaactctaccttctacctgccctcaattatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgc

SEQ ID NO: 109325 - DNA, 1520 bp, Oryza sativa
gggtgggggtgggaacggctaaagtgtgtgatgtggtccactcgccagtagagagaggagggaggtggggcaacggctaaagtgtgtggtccacttgccagtagagagaggagaaggaggggcaaatgttaaagtgtgtgcgatgtgtctttacatggtccacttgccagtatagagagagagcacacgcgcaataggtaaggtgtagtgtgtttttagctagactacttgttagagagcaacgggtaaagcatgtgcagtgtgtctctactggaccacttcctagtagagaaaaggggcaacgggcaaaagggtgtgcggtgcggctctatcggaccactcactagtagagagagggcgcaacgggcaaaaggtgtgcggtgcgcctttactggtccactttctagtggagttaccataggaccagtgacaaaaccgaaaatcagggactaaaggggatgccacgaggttggtgtgttggataaacccatccatgtctggaccgacattagagtggacacgtggttgaggtggttggcggcatgttaaggtggtcggatgaaagaacaaaggatgagaattaacataccatgattctcatagcgacaactaactagctttgcacctatggagtggtagcttcgtcttgatcagtcatctcctagtatgatatgatcgaaatcttggagattcggttagatggcaagcgccatagtgatacacaattggcttcgcggtgtcggccgtcggagggacgcacgttgtgtgccaagcaatgaggcatctcgtgtacatgtgttgcgtctttgctggtccacttgccagtacacacagacagagcatgcgcaacgggtaacgggtgcggtgcgtttttactggaccgtttgctagagagcaacgggtaaaggatgtgcgttgcgtctctaccggaccacttgccaatacacacacacagagagagagagagtacacgcaatgggtaaggggtgcggtgcatttttaccggaacacttgctagagagcaacgagtaaagtgtgtgtgttgtgtctctactggtccacttgccagtacagagagagagagcacgcgcaatggataaggggtgtggtgtgtttttactggaccacttgctagagagcaacgggtaaaggatgtgcggtgcgtctctactggaccacttgccaatatacacacacatagagagagagcacacgcaatgggtaagagatgtggtgtgtttttactggaccacttgctagagagcaacgagcaaagaatgtgtggtgcgtctctactagaccacttgctagtagagaaaagggacaatgggcaaaaaggtgtgcggtgcgtctctactagaccacttactagtagagagagggcgcaacgggcaaaaggtgtgtggtgcacctttactggtccactttctagtggagttaccataggaccagcgacaaagccgaaaatcagggactaaagggggatgccacgaggttggtgtgttggataaacccatcca

SEQ ID NO: 109326 - DNA, 525 bp, Oryza sativa
tagtacctgtccagcattgatgatagtcacatcattaactgttcttggagctatttctttacctgccaacaaatgtaacaagaaaaaaatgttaaagacaatgaacaaaatataccacataacgcttctgaaagacaaacagttgaaggcaatattcagagaaaatgatgcagatgcagcacttgcagaaacaataatagcagattccatggaaaagtaagaggagaaactccaaaaactaattcggtgcatctaattcaaggataactctaccattgaagcatgctcctttgttgggaggtgttatttactgacttatccaggagcaggaagcatgctcagaaaaaaaaaatctactacctcaaaacctccatcccaaaatataatagcttttggtgaatctagatagacaattgtccagattcatagctagaaatgcttatattttgggatggacagagtacctgtatattctactgatcctgtcaaatgatgtatcactgtagcagatgagaactggagcta

SEQ ID NO: 109327 - DNA, 759 bp, Oryza sativa
attgctagattacggtcataatggctagcgaaagtacgtacgtacgtgtgccaaacctgcctgcctgcctatatatctgaacagagtttcaacaaaagtactcctccaaatgatgcactacggacgtagtattattctatagcagtacagaactttacatgtgttggaaaaaaatctaaacaagataataatatttacttgttccgtaacatttcgatcaaaactcaagagctgctagttgttattatgggcggcacaaaagcgaaaatgagctggttgtgggctccaatgtggttgacgatgatatataccagcccatgggcttacttttgggccttcttatttggagtgtacaagaacaatttaggcccttattagttctcaaaagtttaggcttaattagttcacctgcgtttttctcttctatcttcgtcttagctgtgaagtaaagtagtaaaccatatatgaaatggattatatactgccaggaaaaaaaaacacgtgaaggataataattatgtctctctgaaattaagtactccagttcctctcgcatgtgcagtttgcttcagatgcatgcctgcctgacacttgttcaggcttgcttctagatgatactccggaagaggagtttgatcactcgaggggatatcctctcgttgtttgcatatcactcaaatgattataaaaaaatttgaaaaaatttaagaagatgtattaatatgtgatatatcactccacaacatgcaagtaaaaatt

SEQ ID NO: 109328 - DNA, 1065 bp, Oryza sativa
tccttcgtatcctgcgaattttgctacataacatttaaaatttatataatttactgatagacatcgaaaaaatatgtcacgacaaaacgacaaatgacacttttgactcaattagagaaatgaattcgagaaagacgaaaatgcccaccacatgcttcagacatggtgttagagtgaaaatttataaattatgcatacatcgtattccatgttcactttaggcttagctcaaaagcttttgaccgtaggagtatttttgtctttttaaagaatttttcgctctaatcgagtcaaaaataacctgcaacaaattacctatggttttataatgtgtggcaccgttcacttttgatgtgatgtttgatcattcatcttattaaaaaagaaatatgtaaatatcatttattttgttgtgacttattttatcatcaaagaaactatagtcttaacttatacttttacatgtgtataccaaatttatttattttaataaaacgaatggaccaatgttatatgaaaagtcaatggtgttattaaaaaacaaaggtaatagtaagttgtcatagggtaagtttatatatacctgagatctaaaatgcatctatagtgatattcgtctttattagttatctaaactaaaaggattattctttatagctaagctgtatacctatctttaagtaatgttatatacttatatcttcatttagtttttcttttaagctaaagtttcgaggaccaaaacctagctcttttcccccctcaaaacacatacgatctggtcgaaatccactttctccttgcaaccccattgtaatcgtagcaaaaccccattgtaatcgtagcaaaggtatatatgcctcacgatagtactagtgtgcttggtcgtactgcaccaccaacggtatagcttagcctctcagtgatcactaccaatcctaccgccggtactggatcaacaggtcagaagtttggcagcaaaccccagttggcgatgaccttattatgttcggcagcagagcatgacaaaaaacaccaaaaccccccaagtccccaattactcct

SEQ ID NO: 109329 - DNA, 715 bp, Oryza sativa
cctctcaaccaatcacaaccttcccacatttaattccacctactttatgaaaacccatgtccaaccctaaaactccttatattctaggaccgaggtagtaggaaacatgcaacactttggacctatttggatggggtttgtttaggacaagttgctggtaaaatgcaccagcagattgtccccatgggcttgcttactttggtctgagtagagctagattatttgaactcctaggcagaggctaactaagggaatctaagattctaaggtaagtcagatgtggttatcattaatcttcttattttgcatgtcatgaagaaaagaaaaacgtgtcatagattaaacgagaggaactggaattctcaaatttgagtcgagtttaaagttttattaccaaataagtgttatgaccagtgtgttaatgtctgtaatcttggacgatgttgtccatttgctaagtttggcttttggaggtggtatccaacaaattcaggagtgtttgggtattctgaatatgcgagaaatggtactactagatgtcatgaactcatgatggttggatgaccattaaaaaaaagatgaaacaacttacctaatattttttagtggcaacttgtgggcattcaaagatgtgatgtcacacatctaattttccattataaatacaattcttatttttaaatctatgtatacaaaataatcgtatcaatggaaa

SEQ ID NO: 109330 - DNA, 582 bp, Oryza sativa
tttctaattttggattttattttatttttatttcgaattttgattaatcttgtattggattattatatggaaacttctttcaatattacttatttttaattccgaatttcagctatttttagattgtatttctacttggactctccttttcttttttttcttttttctccgattaacgtgggaatttctagcccccacagcgaacatggtgccttctttcaaagctgttttttattataaattaaattttagttgttaaaaataatatcattggatattcatttaaatttaattttatataattatgattttgttgctacaatgaaaaatttaaagttaaagtttagtttttaagactgtactaaatttggacacgccttagcgagttggacggagagatgtatctctaccaatgcataagttttctggtctatttactctttttttttcatccataggtaaaaaaaatatcacattttaattctaattataccggctccaaaatatatatgcacgcactgtgtttgaatcctaatcacctgatctgttgattgatccttactatccatataggataaggaa

SEQ ID NO: 109331 - DNA, 1074 bp, Oryza sativa
gtcctatgcctaaaaccgcaaagtcactgtgtcctgtagcaaaatttgccaaaaaaaatatatatgtcaatacattagaagagcatagttaaaacaattatgttttcttaactactccaaccgttccaaaatataacaacttttggatagataagatatatcatcatactacgaatcgagacatgcaagcgagctcattagtcacttttaggtatacgggtaagtatacattacacttatgacagaggaacttcctccatcttcaaataaatcaattacaggctatgaatttgaataactggtcattgttttattttgagatggatcatatacacagtattgtggcagcacaattggcagggcacgacaccatccctacctcctgtttgggggagtttttggcagtggcatcttatagaatcttcagttgtcagaagctttgtcaaatagttcatattttcacttaaattctataaaattgtagttgtgtaatttagaaaccaaactagaagacaaaaactggattttccagcttttccatatatattctcaccagctgtttctcgaaaccttaatctctcaaaaaaaaaaaaagatcttagtcacgacatagatggtcgtgactcagcaagggtgagattaatacgcatatatcttggccgatatatggttttaggccccgttcgatctctctttgggagatagtttttttttcacgcaaaacaagaaatatcattagcatatgattaattaaatattaactattataaatttaaaaaatggatttatttgctttcttaaaacaactttctatatcgaattttttttaaaaacacaccatttaacatattaaaaaaacgtgcaaatgaaaaaacgagaaagttagaatttggagttgaagaatataactgagcctaagtaccattcaactcaagtacggatgcaggctgcttgtagatacacatatagatatagtgcgtgtctctgcttccttgttaaaatcgtggtgtatggtatcgtcacatatgctaccacgttttaaaatataatatttttaacgctcaaaattaattt

SEQ ID NO: 109332 - DNA, 500 bp, Oryza sativa
ttgggcctttggctttcttcttaagtgccttttggaatgctatgatttgactatatataatacagagggagtaaaaagccaataaacttctacattaatcgggaagaaaagactaaaaatccgtatattgctgcattgcagacatctatcaatgcaaagcgcatgacagcacacctttttctcccttcagtccagggaaacagttactcttaaatcctgataaactggtaaaagcacatatctcttttctctatcattctactgctacagttcactttcaccccgggaaacttcaagcatagcgagcatttcaaatctcatggttgggacaacacaggaatttggacgcacacatggggcagaggcgcagagctcaatgagctagtaatccagcgcctttgtgtttgttttacttatgtgttgtgtcattttctgcactggcactggcactgttattgttttgttgttagcttagctacctttccagtgagggcattctg

SEQ ID NO: 109333 - DNA, 1010 bp, Oryza sativa
ttgcccaacctctttcaagcttttatgagactttgccacataactatgatcagaaacagttattgattcataatcacggcaattgaaaggtgatgctgaaacctaaaaaagggaacacttgagtgagtggtacaccagaaactaatgcatgaaaattgattctctcccagtgcgtcattatattgataaatgaaggcaaagtaaagcatcctagtactacataaaccaggtactctaacatactggaacagtacacttctggactcaagaaaaggctaaagaaagagaacctactattttcaaagaaaaaaaaatcaggaaaagagcaattagaggctggatttatttccatataattatcaaaaaaagaaggaaaagagcaatttcgatttctgggttctcattagaataccttcttaaatgcttaacactttgagatatataagaaataaatgctcaaacattaaacaaaaaaccataaaataagaatacgattcaggaacagtaattgaaacatttaagtttcttaactttgtagtagagaactgcatcatttagaaattcatgttcacagtatgcaacatttgagcaaatttcctcaattaactctgtttctgttttgaattacagaagttgttaatataagggcctactgaccttttcttccccacatgattcaaatgaagaatgtacagtttcagcaggttttttcaccaagtcctcatctgttgtgaccaatattttctcatttatgcagtcaaacgttgaaaagttgtcagttgaactccgcgaatggtttcgattatcatgagaaggggaagcagatctatgttgccgcaaggtctgatgtttcgcacaagcattcctcaagttatcttggctgggacttccaatttgctgcagtcttgatatatcgcagaaagagttgaagtgagactgaccactgtggtaagtatttgatgtatttgggataaaattactgtgaggggaattcttgtccaatgaactgt

SEQ ID NO: 109334 - DNA, 1071 bp, Oryza sativa
tgtattaagggttaagagcttcttccagatctagaagagaactagggttaacgcaagcaaattcccagacaaaactactcccggtgggagagagatgaatcagaaagagaatgtgaatgctcaccaagatcccctcccctccccagctctcctccccggatggagatcggcgcctctcgtcttggcgcaaggagcggacacgacgacgggaacgggacgggagattttctttttcttttatacgcatgtacctttagctaatctagttctaaacaaataaaatcaccatgtagaacaagattaaactacccaaacctatacacacaaacaaaccaactaacctcctgtcaccttaaccgtcctgaactcctgatctgaactctgaaactcctttgaaccaacagcagggagagagggagagcgaaagctgcagcatcggggattcgctcgcagttgaaaaggaaaaccacccagaaaaccaaaccgtcgccgccgccagaaacgcccagcgcgtggaggccaggagcagcacaggtacaacggaaaaatgcaatgcggtgcgaagcgcgcgcggtggagttgctcctctcctcctcccacgaaatcgcagtctttttctccctacttttctatgccctttcctctcttctcactgcccactgttcggttttttggaggaagaagacgagctcagagcacaacaatggtttgggacctccacgcgactccgctacacggccaccgctcgcgcctccccacccgcacgcggcacgtcaccgacatgtgggtcccgtaaaaggtgtgacccacatgtcggtctgtgagacaagtggcaacgcggggtacacgccctcgcaggttgcgagtacttcgccggatgaggaattaaatggcggcgtttagatgaaactgattaaataccgggggtggcgcccgcgtgcgtccctatgcccacccggaaacgtatacagatctgtggaacactgacactgggcaagcgggcccgagagatccgagccatttcgcggtacggcctcgccttgggccatgaggcgcaatggtggaggtggt

SEQ ID NO: 109335 - DNA, 1193 bp, Oryza sativa
gagttcgaacgctctgactttctgacgccgtggcaggcatgcaggtgcagcttcggggcttcggcggcggctgttttgtgaggtcagatgagcgagaacagctgcccaccgcgatctctgcccggtgtcgtgttgctctcaccggaattgaataggagtagctcggtgacgcgcgcgtacgtacgcgcgccagccaccaccaactggaacccatcaccccggcccgcgccggaaaaagaccgagcgccgcatgcaactcaacgcgcaaccaccgagcgccagagagagaggcttctcgattccactacccgcgatggcccaagcgaaccgcccggcgcccgtcagcgcggcagcttagggtgtgtttggttcacggtcatgcataaacgggatatgaccatctatattttatattttgttggatatgacgatccagttttttgtttggtttgtatagatatgacaatccaattttttatttgattggagggatatagcatggatggaaaaagccaaaagttagtgcgacccatttgtcatatatatttttttatcaaaatataatcatctgagatcttgttttaaagatttaattgtaacaaatataatggtgtaatcaatcataaattagataaacggtttaggagaaaaagtcatttggagcttacttaacagaaaatcaaaccaaccacagccaatcagaacaggacacatcacccagaccaaaactggatggcttcatccagccaaatcggccggatgcactcatccagcatatagagagaatattccctattctgggccgccccattcatcctgccctccaaccaaacaacacaaaaaatcaagcggccatctcccatccagattcatccacccaaccaaacacactggtgtggccgccactgcagtctgtagtaataaacgcaccaaagtaccaaacgctggacccacgcaacgctagtgtgcagggtaaacacacacaggtcgagaaaacggactactcctaaatgtgtgcaccgcacagtggtcgaccgatcgatcgatcccgagtcccgacgttttttttgtgctcggtggagcactccggggagcgaggggacatgaatggcacccactagccattcattcaacccgagccaactgggaacaccacgcggcgagtccaccgcgacgacacacacgtactgata

SEQ ID NO: 109336 - DNA, 579 bp, Oryza sativa
catatttttttctctcaattattccgggtacatccttgtcgtcgagactgtttccgaggattcggcagccataatttttgcccacatcgaatacgtccttgtcatcaagactgtttccaaggattcggtattcatttttttctctcatagatattttattctcttgtacaatgagaaattacgaagctatttgaggaataaaaaatcaataaagcatatacatataagcatttataaatcaaaccatatactaacattaatattgcatattttcttaattcaagtatagagtttaagtgtcatgcatcatctcccttaaaaccaatatctaagcctcataaaaagactaaaatacatacaagctatgctagagacaaataaaccttcatagtattgctagcatgcacaaaaatatactatatgtataaaacaaaacactcttttctcaatttttcttattatgaaattttgcttaataaaaccatgaggtacaaaaactccccctcaaatcatgccaaaaggatgaattattcccaattctccacgaagaaaagcaaagcgattagaatccaaaggttt

SEQ ID NO: 109337 - DNA, 923 bp, Oryza sativa
gaccatatctcaatcggtaatcggtaacaactagacccgtcacagatgacttatccgtgatgggctctatactaatgcccgattgatatgacttagttttttttttccattcgtcatatgaaatgtttatatttgtgagttgatatgtagcaaaataattaactgtagtataataatttattttattattcaaaatagtttttcgggtggtaaatgatttcaaatggaaaaattgtcaacaacaaagttatataacttataatgatttacaacttttattttggtcatttttctatataacttttttttgaacagtttgaatttaaatttgaaaatatgacaacttcaaataacatttttaaatattaaatgatttcaaatgaaaaaaattatcaacaacaaagttgtataacataccaatatttacaacttttattttggtcattttctatataacatttgtttgaacagtttgaatttgaatttgaaaatatgacaactttaaaacaacattttcaaatactaaataatttgaactaaaaaaagtcatcaacaacaaagttgtataactcatcaagatctataacttttattttggtcatttttctatataacgtttttttgaacaatttgaatctaaatttgaaaatatgataacttcaaataacattttcatatactaaatgatttcaactaaaaaagtcattaacgacaaagttgtataactcatcaagatctataactttattttgtcatttttctatataacgtttttttaactgtttgaatttgaatttgaaaatatgacaacttcaaacaacattttcatatactaaatgatttcaactaaaaaagtcatcaacaacaaagttgtataactcaccaagatctataacttttatgtttgtcatttcttcatccga

SEQ ID NO: 109338 - DNA, 591 bp, Oryza sativa
gaattccaacatatgagacataattgatggatgtatatcagacataattgatggatgtatgcgatatatcccaccgacgtgactataagtattatctcacaaattagttatatattgtaaataagttttgaaaaaaaataaatacattatccaaatgattaaaggtgtctcatgtgattatcaacgataggtgttgaaaagaaaccaaacgctaaactatagatatttgttaaaatttaaataataagatagtgctttgaagattatcttggtggtatgtcttcttagctataattttttagtaccaccgaatgaacctcggtcattttttaaagagaatattttgtttatatcatacttatttatgaagtaatagttaacaccataaataaatggtgtttactctataccataaatctactcgaaaattaaaacaaaaacactattctgatcacattcatcttctctttgtcctttactgaagggcaccaagcatagacaacagagtttgctacgctaacataagtatagcaagggcaaacatatggctaagttgaagtgtgctagacttactatttatcgatgccatac

SEQ ID NO: 109339 - DNA, 1031 bp, Oryza sativa
taggccgccggatggaaggttctgtactagtgcgattaattggcgccacttgtcactagagaagaagccattggtaggtacttctactccatgccatcactgcatcacatgagttgtaaaatgtttctttctttctttcttatatatggacaagatgagcatacatgttctctcacgcttcctatggaaatctctcaaattagtggcttccatatcgacttagttttgcaaggaatgcatgttaaggagtaggcatataagagttaaaaacgctattggtaggcaatgttgtatttaaattttttcaaaaaaattgagtgggtgcactatgggcttcctattagtgtgccttatgtttctaacccgacaacattctttagacgattcagatcgctgtgagaagtgcgggggaagggctctttagtcccggtttacaaccctgtcccaggacacccatctttagacccgtttaaaataaccgagactaaagatccatcggtcctattggtgttactaacaggaacaccaaccaccaaccaggactaaagtttttttttcattgcttttttgctgcttgcatctattgattttgagcaccaacgccgtcacccccaaattcccacaaatcatccacaaatcaagcacaataaaatcattcacaattcacaagctcatcaacaaaatcatccacaatccacaaatcattctcaaaagagtaaaatacactggcggtccttaaacttgtcaggaggtttcacttagtccacgaacttgcaaagcacacatcgaggtccctaaacttggtatattgtatcatcccggtctaaagccgcatttgaccgtggtcttgcctacgtggcatgccatgtggacgatgacatggaattatttaatttttttctcccttcttccttcttttttctctttcttccttcttatttctcggtggtgagaggcggcactaggggagtggctgtcgtggtggtgcttggcgaggcaccggccgaccggcgccacggagggagggcggc

SEQ ID NO: 109340 - DNA, 641 bp, Oryza sativa
aactattttttattataatatataaaaatatcaaaacatatatgattttattaaagtattttttaacactactctacgcatatggttttcatatttttaagataaatattttggaaattatttatagtcaaagatttcaaagtttgactttacccttgttcaaagcgactaatattgtcagcccgaagggagtattactccggatttgagctattacttaatcatcaccttgtacgataaaatttgaattcatggctagaaattatgttgttcccaattgcattatgttgatgagctataatgctatcattctctgttgttctcaacatatctcttccaagactttcatcaaaagttggttattaaatttgtagaatcaaacagaaagaactaaacctatggtgggaatatgtttagtaggatatatcggggcttttaggtcctagaagagagcaaatgctaattgccaagacaattcaattcaattatatgataaaaaggctaaagtgttgaaagaggaaagagggaggaattgatacgaaaagcgtaggatttaaccactatctagtcaaatatacgtaaacatagctaagttctatgatgtttacgggttcacatcctctaccataatgtcactacca

SEQ ID NO: 109341 - DNA, 636 bp, Oryza sativa
gtcattagaactactatcggaccaaccatttctggccttcaatctcataagctcaagcaccatccacaacaatgtgaaatccttctcacagccctttgcctcattgtacaatagatcattcaatgcctttttcaatgcatcaaagttatccaacccacgggcggacccagcaacaatcttaggttcagcatgacgcaacatctcttccaaatctgcaaaattaccatcatctacgctgacattaccatcatcggcatcatcaactgtactgtgctgaccattgccaccaacaacatcatcatcatcaacaagttctactgcacttcttcttcttcttcttcttcttcttcttcttcttcttcttcttcagctactacaatgacatcctcgtcccagctcaacacttcgtcgtgtactgtagcctggtttggaacttgcttgcttgggatctttccatgatgtgaccagtttgtgtatccctcaacaaatccatgcatcaccaagtgttgctcgattacagatggatcattccaacttttctgatttttgcagtgcacgcatggacatctaatatctttggtcttcttagatgcagcattcttcttagctgctttcatgaatatgtcgactcattca

SEQ ID NO: 109342 - DNA, 530 bp, Oryza sativa
atgtgttaggctttggagacatcgggatcatggttatggttatgcctgtatgacatcgtcatggtgaatggaagcatagttgttttggttcgtgataatcatgtcaggtaccttttatcgtcttggtgaattttacgagatgttttgatcgatttagaagaaacaaaattcatagtttttgcaattactcctgaaatagcttcaaattccaacaatctcattcactgtagcttgttggtaccaaagattaaagaaggcacaggacaagcagtatttatgaaacttatctattggttgaaattaaggcgacaatgtggctattgaaattaagtgaaaagtaaaaactgaattggctagcagagagtgcagtggagttggtaacggtcttgctagctgtgcttgattctgtaacacagttcgatggggggaattcctcgtctagtgttcgacagaaaaaatcctaagttaatatgtaaatatttattcatttaataaaactctcttttccattaaaagaaaggaaaagcacc

SEQ ID NO: 109343 - DNA, 1281 bp, Oryza sativa
aacgagctagggttccacaggagtcagaggacccggacaagagaagaaagacaacgcccgcctgacgcgcgggccccacgcggtcgggcgacggcgtcagcgcgcgcacgcgcgcggcacgtgcgaaaggggaacggctcgggggctggggcggcttgggccggcggccggcccaggaagagaggagggagaggcggcctgggccgggcaggccgggaggggaggggaagagagaggcagcccgggagggagagggaagagggaggtgggccgaggggaagggggcccaagaggaggagggagagaaaaaagggaggagaggaggacttcggactgggcttggcccaaaggaggaagaggagggatttttaggttttctttttattgaactttgataattgtttttgttgtttaataattatttccggtgctctgaaaattcaagcaaaatttgagggctcctttttagaccaaggagaatttaacaaaaattctccgggccacatttgaatttttcttgcacgtattttagtgtttgccaatttctttccgaattttaattaattctattattccttttagaaaatggattttaatttggaatggatttatcaggacgtgacaaatccaccccccttacaggaatctcgtccccgagattcgaggaggctagcaagaagataggttgggcggtcttctcttcttgtccgacttcttccgtcgcgtcttttataacaaacttgcctagcaaaacttctccactctggactgcttggctcgatctcctattgcagatggaatcttctcttcacctgacttttccctggttgcacctctagctgacttcgactggattatggcacttgaagatgggacttccgttctagaacttctcataattcatatctttggcgtcaacctcatacaagttacccacttcatgtcatgcgtcgagatcagctcgtcattactaagataccatgcttgtcatcatttagcattcaaagtattcctttacacattcagccctgacgtattctttttagatttctcttatcaatcacctttcgacctacttcttggttcgataataaacacctttgctggtatcttctatcaatcacctcttaaactttgtcaaccaagtactcttcactccgagagttgtggatgcttctggtgacgatggggtcctttggcttgctgcctttcagtgaaaccttgaagtgtttcgccaaaagctatactaactgtcgttgcctttgatccgaaaagactcat

SEQ ID NO: 109344 - DNA, 1476 bp, Oryza sativa
tatgataactcgacgaattacataaaaaagattagagtgtcataaatatggaagcactaatcccgagaacgcaagccaccataacaagttttaccccttgttgaagatcgaaaccgatgcagctcaacccgaaagtaagaactcgtcgaaacaaaacgaaagtaaaaagggtggcaatgcaccgagattgtattgaacgtgtgttagtttgattacatggggctcgggtctatttatacccgagaattacaaaatatgtccatatcggacacgactcttatctctaacaaactctaagataccataagtctttgcggcagacttttgcccaaacatatctctaagaaaattacataaaatatcctaattaattgatacagttgccttctcaggactctatacatgcgtagcaattatcatgaagcacatcaacctaaaccgacaacatatgttgtgtcatattgtcggattcggctcaatcggctaacctcgtccgacttgaactctgccgatcttagtcgtagccgattcgaacttcagccgatcctcactctgtttccgggacgatttccatctcgaattccatctcggtttcttcttcatctccgatccttggattaccaaatttggtcgttaacagctgtgttgctgtgtttacttccgtttaaacttctaaaaatttcgtcacatcaaatgtttggatacatgtatggagtattaaatgtggacgaaaaaaaaccagttgcacattttgcatataaattgcgagactaatcttttgagcctaattacgccatgatttgataatgtggtgctatagtaaacatttgctaataacagattaattaggctaaatagattcgtctcacagtttacaggcagaatctgtaatttgttttgttctttgtctacatttaatacttcaaatgtgtgttcgtatacttaaatttttttaaaaggaactaaacatggccgcagtcgtcaggaacagttgcagttacagctgcacccaatctgaatcctcgcttgagctgcatattgcagctgttaagcggtcacagtgcactgatgtcgcgttctgtcccgagcagccacattgaagattcatcgccacgcacacgcctgttgttcccgactgaaaaccgcggagccaaatgaagctacacgtttttcgtcggaatttggcaggcgtggggcgaagcacagggcaagtgacgcattgggtgggggcatggccccacgcgacgcccctcacccgtgtgacggcggaagcggcagcatagggagaagaagagaagatggtatggcggtggcctagggcagagatgttggcggcggaggaagaggcggcgacagatctggcacctaacctcattgtcatcgtcgttccgtgctgcctcggagcgtagcagcgacaaatcagctgtgtcgccagaacacccgtcacgccgtctgtcgtggacgcaccaccgtgcc

SEQ ID NO: 109345 - DNA, 1208 bp, Oryza sativa
aaaagtatgtcgggcatataatgctatagacaagtcatgtatgcccgaatgaaatgtctcatagccaaaacccaataagtagtgatgatgaagagacatatcaagacttatgaaacatcacaacataggatgaactccttctaaatacgtgcatagcaaagagtgaaaagaaatctttatgcactttcacaaaagaaatgaaggaacaaaagaatccatcctatattatgaaatcaaggttgcaaagaaaatccatagaagcaataatgaagtctaccttgggagtcatccacttccaacatgagaccaaagaataaactcaatttaaaccattagtcttccaaggtatagaataaacttcccctcaaggtgtgcatataaggataaatttaatgcatacatatgcactttactaaaatgagaatcggggaggagtttacactatattttgggtcaaggaggcaaatatcaccaaaagaaataaattgaaggactagaattgtaaagcacactttcataaacctcacatctcaagatgatggtgcttaaccaatctcatccttcttcacccattccttcggttgtcataaatcaatctccccttgatccatcattatctcttttctctatttgaatcaatagaaaagagaaagcatcaaaagcacacgagtttcacaaataatgatccttttgatgtggaggaaaattggatcacttatttgtgaaacctcataatatagactaaattctcccaaaagtaatgcacacatatggtggaaggcaaatttatgtgcattatttgacatttaaatcaagcaagggaatttaatccatattatgaaaggtagctagataaaatataagatgaaaagttaattgaattaccacttgtgaatagcatacctttgagaatgtttcacttctcatgagactaaacataaaatacacttaacaagaagttagtctaaaaaaatacaaaacataggacatgctccccctaaatatgtgcatgcaagcatttgaattacttgatagaagcatgcacttgtctaatgaaaagaaatgaggagtacaccctataatttcaacaatttgcacataaatgatttgcaagaatatacatgtgccaaacattgggtagtaataatgcatgtaaattgccacaagataatagatggcaatcaaccataagaaagaatattcatgac

SEQ ID NO: 109346 - DNA, 525 bp, Oryza sativa
tctaattcctgcagccgcaattggtacagaaaattctagcatggcagtccctagccaggtgacctttctctttgcatctaagacaaacaagcttctgattagtagccataccagcaggcgtggagccagagttgggaaggtcccccttctgctgctctgtgtgcacctctgtctctcctttctgcccttgatcaatctccttcagcttcaccgggcgatactgcagttcctgcttctcctgaccttgttgggggccttttgaatcagcccctttgtctccctcagatccttcaccatggaatcgccttgcgggttgaaattgaggaggttgatttggaggatcttggaaaccatcccatctcctcccagcaccacctcccccatgaccaccccactgattgttgcggaaatcttgccgcggctgattccgccctcgccatgcaccaccctgattagccatcctgttcccctgaacaaacttcgcaaaccggcgagaatcaccggagatggtccctggccaccttg

SEQ ID NO: 109347 - DNA, 559 bp, Oryza sativa
tacagtccatgttaattaccaagtggcgtgttaattaagcatgttacagttttgtactaaactaatctagcataaaagttgtgcaaattgtcacctaacctgtgtgaaataggagtggcctagtagtagtagatccaattacccgacatgtcgaccaggcatgcatgtgcgtctcctgccgttacacggacaacggacaaaaacagtagttaatgcctcatttgaaaagtccatatcagtccctggcaaccactagtaattagctggcacatatcattaccatttcatcaagtagcgattattataacattccattctttttaagtctctgttaccgtactatctagcgaattaacaatcatccataattgctagtagatccatgtgctccagcactatatactagtacaggctacaaatacacagctcatgtgacctatacagactcactgttgcagtagtagtagtactaccagtacagtatttagtgcggcaatttttcttttttattactcctccattgatatagcactgcacagtgactgacttgtcaatgcct

SEQ ID NO: 109348 - DNA, 3616 bp, Oryza sativa
gtcgtggcacggctttgcgccgcccttgggtgcgcatcctagccggcgaagcaggagccgctcagtggtcgtcgctgcacgcgcgcaccagcttgccggaccaccgtcgttccgctcactcgtcgccggagagaaatgggatcaagagagatggatttgggacctagggttttgcccctctccccggtcgatgcttcattcgtcgcggggatgattggagccgtccattagattggacggctcagattcgcccagcattaggccgtcgccgccgttgattacgctgcgcccaatgggccgcagaagtgtatcggtccgtccccgcatatgtgggccgcgctcagttgctcagcttgcgggccgtcgaattgactcaactcaccaaagatgggctagcccaagtttgggccggcttgggaagacctgggccgaaagcaaatttgatcaaacaatgtggctcacatttttcaaattaaagtccattggataaactcttaagtaggctcgaaaaataaatctaaaactaaatcctaaatccatgctaattgataaaattagactcggttctacctatttgttaatatatcaaattagacttgatttttacagaattgaggttttcaaggtgtcacactatcaaacggtgtttttcctgtagcaacgcacgggcactattgctagttagaaataatgtgtaagatagctagacgacgatataaacttacataaggtgatgtggtttatcataatttaaatagtatatagaatgatgatccaaatgtaaaagtaatatgatgtggctttatgagagaagataatgagggagataattgcgaccatagattaataatttgatggctagaaacaatttgaggtgatatggcttaatgagaaaagagagaaataacattaactaagtgaggatgaattgtctaggtatatagatattatacaaaatgatggggagatatattgaaatattttgagaattatgtggaatgatgatttaacatgctcggatttttaaagctctaaaattttagtgagggtgaactatataggcatataggatattataaaaagtgatggagaaatatattgaaatattatgtgaattatgtgtgatgataatttaattatcatgcttgtattttaaagctctaaaacttaataaattagcatgcttacatgaggtttgagatgtaataattgttagtggataatgtggcatctttgcatgttgagctttagaatttagaagaccttaactttatagaaagataggatattaagataatggaaaatgtatttcatctccagactccggttatatctaccctatagttcaacaaatactttcactcatcactcatcactcattctttcatctaccctaaagtttaacaaatactttcactcatcactcaccactcattctttcatgcctcactcaacggtctagattatccgattgagatctgacggccggaatagctcccgcgtaatctcgcccatgcgccccaaaatttcgcccttttttcatcccgatcgattctagatcgcgaaaaaatccggcccctatcagttcgctttttttctaatataagtcaaaacggtaataagccaaaacggtttattagggaataaaaataaatttgtaggtaaaacttatatatatatatatatatatatatatatatgttctttgtaacttaaaagccaatgctgaaaaagaaactacgtagaaaatatcttaaaatcaatcttaaaattaagtttgaaaatttaaaatttggcttattgggccgccctcggcgccgccgctccctcgcagcctcgcccttcacctctccgctgacgccgcccgtgcctcaccacctctgtcgttccaccgcgccactacggctcctccctccccatcgtccccatcgccccctcgccgcgccacttccccatcggccgccccgatgcacgccgcgtccccccgcgccactacgacgcctccctccccggtgtccccatcccccccccctcgccgcaccacttccccatccgccgccccgatgcacgccgtcgcgtcgcccgcgcctcaccgcccccggcgtcccccgcaccagcggcagaatggcgcaggccacttcatgttccccaggtacttcgaatctgaggcctcctggttgtggaacaaggaatcactagcaccctcctccctctctgctctactcttcttcttgcaaatggctgcttctggattcctgtgtcctgcctgatgcttgcttgcttgtgctttgcaaaggattaacgcctagacgtcgtgcattggatctggcaggagtgcaattgaattcctcatgctactcatttcagatgattcagccacctgtagaaaatgttgagtgcatgataaaaaaaaactaaattttcctgttgtttacttgtaaattgggatttgcactacagcaatctacaaaatctacatttttcttatctgttggaatggggcggtgtggatttttggttaatttttccaacggcaggattttagctcgatgatacatcacggcagatgcacttggttctgttcaggaaagattaactatgcattctttatttactgattaatattagtatgctttacattctagcgtgtgaaactgttaatgttagtactgcatttcctttacttggttgtaggattcatgtggtctcacttgtgttgatgttttagcaattataattcagattgccctggatggcatagcatatgaatgatctgagatgtcttatacccctaatatttacatgcaggattatcattacttatttgcgtttgttgcaccgtcatttcatttatgtaggtattgcctcgtgatgaagcaacatttcggtttgtcaatgaagccaacaagaccaagagcggtagttctctgtgtcacaaggtagctgaccattattagatcgaacaatggttttatcaggacctagcatacatattcagacaggtggtctacggcgtggcagcggtgcggtcacaagttccaccacggtgagtgcctttctgcgttcatatctctctgtactgaattgatcttgactagcataattatatgctatcatgtttgtacacactgcaattatttctcatatttttacctccaatcgtatggcagcaggttcatggtagcacatgggtttggtaaatctattccaacgaaaaatggtagtgtttgatcattcccttcgttttgtatagctttggttaaccttctgggtgaggtgcactacaattccttgtatgccattgaagttgagtgcttctgcttttttgtgatatatgggagtgaagaaaaggtttcctacaattcctctacttggcctcagatcaaatgatttgaggggcagaaaacgaaacatgatggtattcagtatcaaagctaagtttttttattctttttgcagtcataaaatttgatggaatactaatgcctgttgcagggtaatttgccctcaatctgaggtattgccatgagtattatcattttctccctgcaaattgcaacaaggtaatttgctgctagaaactttgcgcatctatttttttaggaaaaagtacgaa

SEQ ID NO: 109349 - DNA, 685 bp, Oryza sativa
aacaaaggtgtaacaaccgaaaagaacacaaaagatgattggcttatatcagatcaagtgaagcttccgctgctttttatgttccaaagatcgcttgcttccaacagaacagacattgtccaacttctgaagcacgttttcagagttcaggtctactcctactactgatctactacaagactataaagccggagatgcagcattgcatgtcatttggctgtgattattaagataatacagcacgggagatctatgtattagttctgcaaacttcaaacaatgaatccacttggctaggtaaggtaacaaagaaaattacagtagaaaacaatatgcaacatgagcagcataagatctactcctacataaccggttaaaataaaactagccagtagctgcagaaacaaaggaacagctaatatggccagaagaagtagggccaaatcatttggtccttagcgcctttgtggcccatggaaagctgacacaaaaacatttagattccgcacatcacagtgcatcggtccgagtgaagcaaattgctgcgaaatttgttttcacatgcaaattttgtgacattgctccttggcaagattatgtggggttcccctgacgctgatggatatctacgcaacccatgcatcacgaatcagagtataggagacacctggtaaattggtgatgc

SEQ ID NO: 109350 - DNA, 669 bp, Oryza sativa
gatgtggagtttatggaaactatgtcagtgtgttgtgttgggaatggcctaatatgcttaagataacactatatcagtaacccctgtttgctatagctagaaggtcacctggtcacatgatatatatcccttcttttttatagttggtatccactgcaataattattgctataaaccttgcaccacattgcgccacatcatcgtttattgtcagctgttggattcttgaccatgtctctagatcaatggtatctgtcctcacacttacaactgcttgctctggcctgttaaaaatctcctcatctcatgaaagccaggaagcggtgcccttcgaccttctcaactaacaatcccctaattcctgtcaaaaaaaaaaaacaatcccctaattaacaggcgtcacatgcggaaccccctccaacgccgctatacaagcagtcgggttgttccatcttgctcgagcaaaggttagctgaatgaccctcaaacaaaaaaaaaaaagaaaaataaaaggctagctgaatgaccctcaaacaaaaacaaaaatcaaaagaaaaggttagctgaatgggcactgcacattcttggtcagctatgcaaattgggatgtgctctttttaactagaaatcaatcttatcctttctgctcaaatgcctatggcctgttgc

SEQ ID NO: 109351 - DNA, 1276 bp, Oryza sativa
ccatgtgacatacgcattggacatatacatatattaaaatctccacttaaatctttcttttttttatcacttgttagctctgactaacaaacaactaccaatacaataatcacatggtatcactgtacaagtataaattgatgacttacattgatgatatgcaaatatgttatgttggttattgaaagttgttcgtttaagcttctaaaatatgcaaaaccaccatccaaaaccacttcagggggcaatatatatgaacggttttacaaagtttaaggggttagatatccggctttaaagtttggggtgctagatgaactttcatccaaattttagttgggtatttggacattttcctttcaaaaggttgcattttgtttttttacaacactttgatcaacattattctattataatataaatttttgaagcaaaattgatgttattagatacgcctccaaaagtactttcatgtgaatattcttatgtgccacataaataatatactagggaaggtaaaaactatattaaaaattacgccctacatttcaaactagagggagtaggtaccatagtattttttttaagtgtttttaccactcgttcacattaaattcattgttttcacctaggcctaccacttggccatgacatttttgcccctcaacacccgaggttaaataagcacttcttttctccagccaattccctaaaaatgcgctaaacccctttctctctcctatatgatcacaaaaggagccattttattgcgccacgttacaaaagactgtagtagctagtcaaacatatattaagcagaagcaggggcggatccaggaacaaaaaattgggggactcaattacacaatttcttcaacctctagccatatagagacctttagtttatcatttatagtgaaaaaatcgaagggggtgctccgggggtacccacgttggatccgcccctaagcagaagattaaaaacctatgtcaaaggcggcgggcattgcgcgatagatcagagtcaagtgaaccaagtgttcacagtgatggggtttatggctgcgatcctattgcttccccgctaaaaaactcaaataactcttattttctaggtttggacctcctgtaggataacaaccctactcttagtctttttatagatcgggtggtgattgtatacacctgagagtttgacgatgattttttctaaccacccattttggagaacccccgatccattatgtaatactaatggggacaagggctgcaggaa

SEQ ID NO: 109352 - DNA, 760 bp, Oryza sativa
atcgaagcgtttttcatattgcttttagttttctcttagtttgtccatctttgtcggtttgcgccgtaaaccgtccgccgccgctgcgagagtgcaacacctctttgtaagtttgttctgaaaaccttccgttttgcccacgagacgggtagttatctagaaatcggctccgctagccggtttagttatcaaaacccatctaggtttagctctttgctagatcaaggtggttggcaactctaggatcaccgcaaggcataaggtgctgcgatcgtacttgccaacttgtcacaaaaagttgccaacacgatttttggcgactctaggatcaccgcaaggcataaggtgctgcgatcgtgcttgccaacttgtcacaaaaagttgccaacacatagtatagatacattctagttaactgacatattagctaataccctctatccgatgccctcctggtacttcgagaagccacccctgactgtcgagttccttacgacagcccatcatgaccatacaaccggggctaaatacggaggaataccctccccagggaattaacttaggattatataccggcgcggaggaatacccgtactgagctgtcaccatcagtggcccacctctcatccgcaatatataaccccaaataatgatatcccgtaatctagacatcatgtctaaactaccagatactactctaatatcatcgtcatgacataaagtaattgcatatgcaaacattatacccgcaccaaagcat

SEQ ID NO: 109353 - DNA, 734 bp, Oryza sativa
tcattgctcaatgctacaccacgttgagacaggcccaaaccaccacctgaactaactagttccattagttaactaggggtgagactaattacggtgaatctggtcgaccgcccataaccgcgggcatgactattcgaatagttttactctgatcagaggtgtacaactgtatccacaagacacagccccacgacacgtttccgtgcactgacatgccaccacgacataccgaaaagaggccgtgacaggacccttcgcataaccccctctaaccgatcgcaccacaccttagggttcgcccccgtccccagcgggcaacgggcagcccccctttcgtgccgcggtgaatccggaagccgatcaaccggacaccccggccgacccaactccatcacgcccaccctcgcctgggtacgtcggctagagggaagctacactacaagcccaatcgttgcccacgctggcttgtggtaagcacgataaattcttccagggtttccagcgaaccggtccttaatcaccatgggcacaactagcaaaaccatgcacccacagcccaccatgtagtgtactttaattaactaacaccattgcggtggcactaatccaaagctatgccaataatcaaagtccatgcattaatgtgattcccctttgtgtactagttgaactaagcatggctaagcgttccctaaaccaacatctaatcattttgatacccaagttatcgatgg

SEQ ID NO: 109354 - DNA, 1033 bp, Oryza sativa
catgaaggactcaagtcaaaacatgttttatgcaagttggcatgctttcactggggtggcatttttgtcataggttataaataaaaaatgttttaatttgccctcaaatttttattcatgcaagaattagatcaacttcaactaggtttaaaatggaaaattttggtccacaaaaatggaaaagttagcttccaactattttgacatgaaatttttaaggtctagaatttgagtatgttacaagagtgcaagtagcgagacgagcgcggcatgcagagtcgcggtcacggtggagacgaagcgttgatggcgccgttaccgaggagtcgcacacatgtgtgcctatagatagactccctaatttcctgaaaatcctaaattggacagtcgggcttctcacttatgggccaattatgaataaaatgtggtggtaagcggcccaaggagaatatgaggggttggggcgacgcatgccatagctgggccgatcgccccatgccgctcaatgggtacgtccgcccctgagtcacctaccaagtaagcacggactagggcgtcccggctcagcacccatgcgtgattacgataagggaacaatgtctattgtggcgtgagcatcgcatcaagcaaaccaatcctccaagtccaccattcttttgtgagggcatcaactacttcactctttattcaactgcctcgaacaccatgcatttctctcttcccaaatcatctagtataacataggaaaggccgtgtcgaagaccttcccttgcttgtctaggcccacgcgtacatccaagcacctgaacacgcaaagatgtagcctagagggggggggtgtgaaatggtcaaataggcctagaggggtgatgaataggctaatttaaaactttatgcggaagctaaaactgagttagggtcagaaagtttgatccacagtcagctatccgaaaatatcagatagtctgatgttggatcagactgtctgatccactaaagaaacacaagtagatctagtgcacaagggctgcag

SEQ ID NO: 109355 - DNA, 748 bp, Oryza sativa
actgcttcgtattcctgcagcccataactccgtctctcaccatcatggctgtgaccatagatagtttcaccataaccggggaaccccgtgtgtatcggtttcatttgcttttcttactccgaaagcctatacaatatgtgtccttttctggataaggtgttggattttttttccgctgttgttagtactctttcaaaatattaaaacggggtgtttcgtgtaaaaaaactttaaatatataagtggctttaaattatcaagtaaatccaaaattttaaatttagagcaattaaaacttgattagttatgtgctaataacaagctcgttttgtgtgcactaatttttaaccttcatctacagcccacaaggcactgaacatctctacagccttcatctacaaccttcaaacagggccaaggtatgaaaactatgctcccaaatctctacagcccacaaggtactgaacatcgaagtcaaattaaccgcccacaaaacatacaagtcatttattcgtgtgctgcacaaagtaatacactcagtgtgtatggtggaaaataacgtctaaaatctcatttgtttagagatacatatatgtgcgggcgtgccaatgtacctaaattcacaatgtaaacaaaacgtagagaacatgctctctatgaatctgaaaagatcataaatactaattcccaatgtaatatatatgtatgcgcgctccataatctgtcattggacatatctgactcgtgc

SEQ ID NO: 109356 - DNA, 643 bp, Oryza sativa
agataacgtgtgtttagtacgcccttcccttcaagcgagccacttcatatatctttagcagctaagcaaagagaattaatcaattactaattaataatcgatcaaattagcaaagttggctacgaaatagcaaaaggatcggcatctgacgaggaatttcgatgggtgagatacctctgcgcccgaatcgttcaccggatattctctacaagcttcagttccatcagttttgtggggacgttttggcagttcggtgcgtgctggctgaaccgcccgtgtaggctccagcagagccacaggcacacggggccactctgcccgagcgccgtaccgcgacgcgcgcggcaggtgcgccgtgcgcgagccccacgcccccacctccgcgcgtggtggcgcacaccgactgcgacgacgagcaccaagtccaaacatgcgttacgcgtgtgccggtggtgcgggtagctgggctcccggtgttttgttttgtttattttttcatttcacggccgctgcgccgtcctgctctggtcgcgacgcgcgcctgcgcgcgagggcggtccgctcacacaacggctcgtacgcggctgtgtggcgcacgggcgcgtggtggagtggaacggtgggaaggtgcgcgacgtttcgc

SEQ ID NO: 109357 - DNA, 1393 bp, Oryza sativa
atctataatccgattacaccattgtgttcgttgtaattaaatcttcaaaacaagatcttacatgattatactacaatgaaaaaatatttatgtattgccatgtttgataaccagaagcggtttggtacaattaaattcttgcgtggataccaagttttaatcatacatcccagtggcaaaaatactactcttatgcatatatatacctatagttctcaatggaatgaagaaagttgcaataactactttgtgatccaaattcatgaactgtgcataaaactgctctctttttcgttgtttcttgatttgatatgtgacaaatatttggtggtgagtagaagcctgcctctttcgtcgattaattgcacgtacgtcccatggaaaatattggtataaaaacgacattgcaatgatggttaatatatttgatacttgttgtataagagttattatatatataatataatcatgcaatggctcaaatgtaaatagatgttgcagtaagtcaataactactaatgttaataacgtgttccatttgcacagtgagcgtaactcaattagttagctaggttcctgttgatgcaaaatctggtgccacacacgaaggtcaagagatttccttagctctggtgcaagtcctaaattttgatgaggttcaggtgtgtcatttagtttgatcttgcaactaacaaggataatagaaaggattgaaccaataaaccaattggccgatactgatatagtgtgtatatatacatcggctaactaaccgatatatcttatagctaaagcccatagctagcaatggtaactcatcgactagaactccgataaaacgttgtataatagcctattgacttagtagaatcaaacttattagcagcaatctaatagatcggacctaaccgagataatataagattgaagataataagaaaaacctatttagctgatagatctacacaattgtgatggatatattgaaacaatctaaaacaacaatgtgattagagaaataccaagatagtcagaatatcggacctaaccgaggaagtcctaattaatccaatacaactctaaacaacgatgcagttaaagatagagtcgatatatctgataggcaatgcttgcatcaacttgaatagaatattggacataaccgagaaagttctagccaaattgatacaagcgaagttgacggaacttactttcctcactggagattgaaacgatgaagcccaacttgagagcaaggccctgaacttggtttctcaccgaagatgaacttaatcgatgcagccccgcccaaaaacaagaacccgtcgaaaggttgccggttccgaaatataattgtattgatctgtggatgatattaaaacagggctgcagg

SEQ ID NO: 109358 - DNA, 959 bp, Oryza sativa
tcctgcacatgcctgtctatggattccagcttcccttttgcttttcaatcacactaacaatgcaacagcaatcctttcttttttgttactacaaaatttttgattggttggtccaactccagtgcaacaccttgcagcttatgttgctgttaggcaggtcagatgcgtgaacattcttcctagggtggtgtatcactgtatcctacagcctttgtccctttttaacactggttgtatatagtaattagttgcctgtcatttgggataaacagtgcacactattaagtaatcagcacatcatcactgcataattattgccatctgatctgaagcttcaggggaaccatatccctgaatttcccaacagctgcagatttcaagtaggtactctagattaggatgctacatcctactacaccctagctacacaacctttgtccctcaactttggctctatggccctgtttagtacacactaaacttcccccaaacttccaactttccatcacatcagatcatatccaaaactttcctactcacataaactcctaactttttttttccaaactaccaactttccccaaacttctccccaattccaagaactaaacatagcctataatagagaggcagtggatcaagcctactccctccgtccctaaaaaaaggttaacatagtacaagatgtaacatttccgagtactatggatctggacagaggatggagtgagtaccattttgcataaacagtgaaaactaatcatcatattatcactgcatcattattgccatcttgtctgaaactctgaatcttcggggtggcaaccatatctgaatcctcccaacagctgcacatttcaagcaggtagatgaggatgcttcaccctccatgagtgaccacttgtcatacaaacacaaattgtagctatcaccattcatctcatatatatatatatata

SEQ ID NO: 109359 - DNA, 1352 bp, Oryza sativa
gacatatgtacgcgtctataaatattttcctttaagagggcacatttacgggcgcatgcaacacaagtagcaccaccacactcattccacatccgcgcacacacatagatcctttcacacacaagcgaggaggcattgcattttagggtgcacggacacatgcaacactaaccagacacattccaaatgcacgcacacacattgacatccttcacactcagaacgaggagagattgcttttcagggtgtatatgacacacgcaacaccaccagactcatcccacatgtgtgcgcacacatggacatccttttacacacgagcgaggagagattgcattgcagggtgcatgcgacacacacaacaccattaaactcattccacatgtataaacactactccctctgtcccaaaatataacaacttttagccctcaagatttgtcccaaaatataacaacttctccaccaacattctcttcccaaccaatcacagctctccaccgttcactttttccacctaactccactactcaaccaatcacaaccctccaccattcacttctacctactttcttaataatcgtgtctaactctaaaaatgcttataatctgggacggagggagtacatcttttttacacatgagcgaggagatattgaagggctaatgcccttagtgcactgaaatgcatagtaaattgaaacacaagtgtgtataattgtgcctaattggtggtaaccttaccaggaaataggaaaagactagtggtaaacataatgttgggaattgaacttgtgccaaccagctctcaccaccgagatccaaccactaagctatggcttagtcctcacatctacaaacattttattgtgatgattgcgaacatttgagttgaatgagagaaaatatggggcttgggggtgtttaaaattttgcatgatatggtgtggtgctattatgatgtttattgatactagcacaaaatgtttatgttttagttaaaaagatggcaaaatttgctacgagaccctcaaaatttgtgttatttgctgatagacagcataaaaacacgtcgcggctaaaagacactttaaaaaactagtaatttgccggaggacactttcggtggttcaattgaatagagagattctttaaaaagacaagaatgcccctagggtcaaaaagcttttgagctgagactagaacgaagatggaatataatgtatgctagtgatgtacttggggatgatggcaaaattatattgcataatttctaaatttttactctaacatcatgtttgaagcatgtggtcttaggggcattctcgtctttattaagaaattatcaattt

SEQ ID NO: 109360 - DNA, 1110 bp, Oryza sativa
agaatctgtaaggagagtaagggacacatagatttttgtataggtccggaccctctaattatgggtaataaccctatccctgttggccaagatcgctgttaccgctatatataaatgtctcgtgagtacaaaggggaggaaaactcacacatttatttgaaatgcatatctcatttttgcgtagctaactaacccattggaagatagcatctttattcctacacataaacagaaccagtttagaatccttctacaatccatacaagattctcctggatgcaataaatagccaccttgggggtaaaacacattcctaaatcatgaatcttcacgaacacaatccacatatgctggattcaaaaaaaggggaaaaagtgcatatagctacccagcaatcaaacaaccgccttgggactaaaacacatactccgaaatcattaatttagcgagcacaatccacatatgtgggattcacaaaaaagggggggaacacatagctacccatagccaccttggggataaaaacattcataaataattaatctacacggacacaatcacatgtgtgggattcacaaaaagggaaaaaagtgcatatagctaccctacaaccaaacaaccaccttggggctaaaacacatactcctaaatctagcgaacacaatccgcatccgtgtgattcacaaaataggaaaaatgcatatagctacccatagccacctcctaaatcattaatctagcgaacacaatccgcatccgtgggattcacgaaaaagggaaaagtgcagatagctacccatagccactttggggctaaaacacatactcctaaatcgttaatctacacgaacacaatccacatcaaaaagggaaaaagttgcatatcgctaccctgcaatcaaacagtcaccttggggctaaaacacattctcctaaatcattaatctagcgaacacaatccgcatccgtgggattcacaaaatgggaaaaagtgcatatactcctaaaacattaatcttcgcgaacacaatctgcatatgtaagtttcacaaaaggggaaaaaaaagcttatagcttatagattggtctcatttaaatttttatatccaa

SEQ ID NO: 109361 - DNA, 1146 bp, Oryza sativa
ccttaaaaaaaaaactttatttcagtcacctgaaatttagactttccgtttaaaataaagtttgacaagtgcgaatcggcttcttatacgctagaagatatttgttattacacgtaatataactacggaatgtatatattcatgtggttgaagaaaatgagaccgaggtgatgaaattgtcgtggtattaattgttacaatcatacgaggattgtggctaccatgggcgctctttcgaaaccgatgattaatcatcaattggctactagaaacttaatttggggaatcccttttgtccatttggtgttaagagatccaagcatagaggcaacatgtggaaatttggatgaggtaaacaacacgaacatttggggtttgctttgcttgatgctctcatgtgggccatgtgttgagccaaattcaaattaactagctaggtcatgtttataggaaatgtgcacatgatcaatgtttgaagttaaaattttgttcatgccaaaatgaacgctagcctggtaaaaaataataattttactacaagatatcgtgacttatttgtgtttttatattagctctttgctactgtggagacttttttgaaactgatgaatggctaataggagttttgggaagcctcttttgtccatttggtgttgagaaaaagcccaagcattgggcagcctgtggtatttggatgaggaaaacaacatgaacattttttaggttgatttgcttgatgctctcatgtggtcagaaccaaaactaactaactaggttatgtctatatattaaatgtgttcttcattttggttttagcttaaggctgagttcaaaacagaggttcatctgtgatttttatagtacgtaaaacaaaacaagttattagtgcataattaattgagtaatatatatttatttgatatttttaagaaacttacctataaaatttttttacataaaatacattagttagcaattcgggaacgtgctcacatgaaacaaggaaatagccattccacatagtcgttcagaattcagcaaaatacttggtcataccaaactgaaaatatgagacatggtatgccaatatttaagccaattttatggtgaaatcaaggtgatcaaaacagctggtccaactttaat

SEQ ID NO: 109362 - DNA, 857 bp, Oryza sativa
tagtaattgaagcaacatttcttctatcctttttttctgaacaaaattgaactagtattaattttcaacttatattaatgtaccgcaaccatgcgtgcgcatgattgttctagatggtgaattgagtgttgagaagacaaaactaagaaaaggagctgaggaatgcaaattacaatcagacagctgattaacaagttctactccaagcatgcatcaacagctttaccgacataattctttataaaaaatcttataattcacccaacatcgatcctccgaaaacgaaaacattgacctaaaaattcaacatagatttgcatcggtccgctagtcagtgagaaaacatataaagacatctcgtccgcataaataataaaacctttctttcctcttttacataaaaaaaagcactacaatcgctgtgaattgaaaccaaagaaaaggtagaatcccatcgaaagagaagccttgtcgtcccccacgggaaaatatttgtacccgtttttcaaaagtcatttcattctagagtccccagtggctcctcaaccacctgcaaattatcaccaacatctagaaacccatgacttcctgacccccctgcaaagtctcctatctctctcatactgttcatttatatgtgcaatttgtgcatgcagtgacagacaaaaaggaacaagaaaattgactgattactgtgccactaaaattctattctaatcatccaaaatattagtctcgtaatccttgagattatattctataaacttaagagagatctaatactacaagttacagattataataatttagttgatgtcttgcttaatctgagataggtacgagtgctactctctctg

SEQ ID NO: 109363 - DNA, 1552 bp, Oryza sativa
cggccggtcagaccgcgggctggccggtccaaccgctcgattaccgccggtctgaccggcatacacagcccggtctgatcggtcacatgaaataatgaatcctgcgatcacctgtgaatccaatcatctccaaaccacttcatgaataaattccaaataacaaaaccaataatctccaatgcccaattattcatcacagaataataataaaaaacacctttgattttacaagtgtgagtgctttactttgttgtaacaggaatgctaaaaaaataggatcctgtttctcctaacccctcaagctggggtctggggaggcatgtgctaccgccggtaggtccggccgatgagccactaggcaccattggtgtagcctcctacttatcctcatctttacctcaactcaacttcggttgccatgggccacctcctttatgttctctcacgtcgctagtagtggtttgtgtgtgcccacacgagacacgaccataggtctaccaggtgtaccactgcctccatcgttgtacgataataccacataccccgcgttgatgttacatggttgtccgatgataagtaagatctatatggtggaactaactaaaccttcacaaactcaagacagtggccacggttcacacataacaaaaatatgtgagatatgtgcggtggtgaaccggtaacgtgttcgttaccacatgttaaaacgtctgagtcggacgaggtgtgttttatgtagaactcataataagaaattttcttattatgtattctacatgtcagctgtacggttcttttttcatttgccacgtgttaatgtaattctatgaactagttagtacgtggcaaataggtggcggttttggtgattgataattaatgcgagtgattaagaaaacctaagggtacacttggatttattgagtgttgaaatgtttgcttgcttgttggtggttaatcatcagtgtgagtgctttactttgttttaaacgtgatagtataaaattgtgccattttcatgacagaggaactgttcctatccattatatttcgtgcagcccctaattgttgtgatactttagttcattctgaaatgtgatacccatgctatataaatatggcattttcatgacgctgaaactgtactgatcgatcgattgtgttcagcccctaattgacacagcatgcaattaacagctcgatgaaagcgattcagtgtttataatttgcagcatagttcagtagccatccagatgtctggcacgtgcttagaccgatggagaaaaaactgacatgatggttgctacatgtcttgagctgttacatctcacaaccactaaataatccgtggttaatcaaaatactactgctgcctttgttccataatatatatcactgtcaaacatgacacgatgtctaaaactaccttttaacttttagtttcttacacacactataagatgtagcaacaaaaatcataacgatagaaaaagtaaattcaaatatcaattgaacaatattatttcttaaaaaataaaatttaatttgtatt

SEQ ID NO: 109364 - DNA, 1649 bp, Oryza sativa
tcagatctactatatgtgttgttcttgttgtaaaaaatactatccttttataaattattaaattattgctcgtgttcgcaaataaatacttgctatagtttattttatataagtactcgtacaaacgaagacaccaaaaccacattgggaattgtttatgtaagtgttcgtaaaagactcttgtatgtatgtttaaaattacttatatttgaaatcaaaagtgtaaatttctatgaggcagcttcaagcttatcaaatttcatttattcacctatatgtctgcagcgcggtatataattctatctttaattattgtcataataaaatctgtctaattcttattccttgtttatttttcaaaaagaaaatatacatatcttatttaactcatataactgtttcctacacattattcgtcatctcaattaatcaatcacaacattctcttctttaattcatccgtctattttcgcatcttaacatatcatcaccatttctcattcaaaccttaatttatacttaaaactccttaaaaatactcatgtctcgaaaacggagtgaggctgtgtttgcaactcctttttcccaacccatctccctcgttttccgcgcgcacgttttttaaacagttaaacggtgtgttttttacaaaaagtttttatacgaaagttgcttaaaaaatcaaattaatctattttttaaaaaaaatagccaatacttaattaataacgcgctaatggaccgctccattttccgtgcggagagaataagttctcaaccaccccatgcgaacacagcctgagtacatgacatagaagcactattcgtatcatacacgctacatatgcatccggaattctaggaggaactgtggtaaacctaattattgggattggtcaccatctagtagtacttaatatgactagcacatgttcacttcaccggtgggactttactactacgtgaaattcctcctcctttcacgttaaataaaccctttacaattatcgccacgttctcctatcttatattagcaaaagttattatacattgcattagagagaaaaaaaagtaccacgaataacaaagtgagtttgttaagtttcttgtgatgcaatcagtctatccggattcaagttatgagttgatacggatgttcgcatttacagattattgtttttcagtggtaaacgacgtaaccatcgacaacgagacacccataatgacgtcattaatcttaaaatatgctgaccaatttttcgagcgcattcgtaaattttaggatataatatttcgttctttccaagattagagtgtgtgtgtgtgtgttttaacatatatgagtgagtgtgcgaacgtgagtgcgtgcgtatatgtacgtgttttttattaatactgtgaataagtagtataacgagtcctaatttcacaataccgagactcccaagggaccaaaacgcaaagagccccccgaaattccaggtgaatcgaaataaatgtgtttcggatggcagggcgtgtcaaaacccacccaaccacgcggctgtcgcgtcgtccgatccgtctgtccatcaccgcatcggacggtggaggcttctcccaggagaggccggggtggcgttggtacgtggggacggttggtctggatt

SEQ ID NO: 109365 - DNA, 2293 bp, Oryza sativa
gtatacttttatgaaagtatttttcaagacaaatctattcatataacttttacatgttcaaacttaacaatttgatagttattcatgatttatattcctaaggtttgacttaaaccttatcctaaatgactttctttatgagtacggagggagtagttatttaattattcagataattcaggggatattttagacggtttcatatttcattttcttttagaaaaaaatggtttcatatttcggggctgattaagtagaaaaatcccgtagtataggaggtaaatagattatacatatttctttctaacgtgaagatgcatagatatactatttctttacttatttataagatacggtatagttggactcatgtaactaatcattactcaatcgttacaggatcaccataaagtataataaagtataagcatatactcttcgtctcaaattaaaaaaacccaacctagtattagatgtaatgttttctagttaacagtacgatgaatctggacatacttctgttcagattcaactagaaaacatctcatccaatactatgttaggttttttttttggacggagggagtgtggagtacctgattacttggttagtggtttacaataaggctggccgtatttagtttgttgggtgtaaaaattttgacgtatgcggacgtatatttgaagtattaaatgtagactaataacaaaacaaattataaattccgcctataaactgcgagataaatttattaagcctaattaatccgtcattagcaaatgtttattgtagcatcacattgtcaaatcatggcgtaattaggctcaaaagattcatctcgcaatttacatgcaaattgtgcaattggttttttcgtccacatttaatgctctatgcatgttcccaaatatttgatgtgacgtttttggctaaaattttttggaatctaagcacacctagtgtttagttcccttcaaatttccaaaaaatccatcacatcaaatgtttggacacatgcatggagcattaaatgtagacgaaaaaaaccaattacacagtttgtatgtaaattgcgagacgaatattttgagcctaattgcaccatgatttgacaatgtggtgctacagtaactatttgctaaggacggattaattatgcttaatagattcgtctagcagtttatatgcggaatctataatttattttgttattagtatacgtttaatactttaaatgtatgtctgtatacataaaatttttttttgacaaggaactaatcacggcctaagttgtaaacatgaggcccagcttggcatggtacaaacaattttagcttttggaactcacacgaagatgtgacaaaagttgttgggtacaggccaaggaatgcacggtgaccatgtctttgatgtcagctttgtgtcttgggctgaaaacaccctacaaatgcaatgtacagcctgtactatattggagtacttgaaagtctccattcctactttgctctagtagcctaggatcatgtcataaaatttgaacttgaaagagtgaccttaaaatttgactctagcagctgcattttgtctctaatacgcaattaagtttgattgattttacaccagctggcaaattatacataggactttcatcttctcaatataaaccatccaaatctaatttgtcttgatgtccatccactatatatcattcaattgtctgcatcaggtatattcccattgtattagataacgtgtctttaagagacggctggattgaggtatgatctattcatttcaaatctcctgacaatatgcctagaaaataactataaactcaagtatgatccattcatttcaaattacatgccgttctagttttgtcctaagttaaatatttgtatctttcaccatattctagacacgtgatttaacatcgtgagatttatattttagatttaacataagaaatactttcataacatataattcacgtgttattaaactacacgattttttaaaaatgatagttaaaggtaaaaaatatttaacttgagataaaactgaaacaacagacaattttaatcagcgaaagtagctgaattggaagttctatggggagtaggagtaggctctaaagaaggcactcctgactgagtagtcacatttcaatcattagccttgctaaagttgctagctagggtacctggatatattaacaagggatttactaattaatcacctcacttagctaggtagcattcatagcaaaaccatcattatttgggctgcagg

SEQ ID NO: 109366 - DNA, 1157 bp, Oryza sativa
agataaggctggactgcagtaggacgacggccattgggacaccaatcctcgccagcaccatgatccccatcctcttgtgcagcacgtacgcgcacatcagcatccgcagcacctccccaacgacttcacatgaatcatatgcctttgtaccagctatatatgacttgctttttatattgagaataagcattattctcatatctccttttccttttctttttcaggtttgtcctcgtacaattgtaatgtccaaaggactggaaaagtgcagtaacagaaaggtgcttcacaaactgaaaagttgaaagccatgtcactgcactacgtctgacaaaagaacaacagctataggtatttggcatttttattggctactctataaaaaaagcacattaatatttgtgtcaaagaatttaatttctacacaagatttataggcagagggcatgtagctccacataatggagctcagatgatcaaatacataattacatagtccttactacatggagtctaaagaaatatatatatatccaagtagtgcagcatcatgcacggccactacttattagaaataaaatgaagtgaataaagatatgcttctgatgatgccaccggcgtgaaccgagcaatctttcatgcagattttcgcctccacctactcccacgcacgcacgcaatgagcaatagttggttgctgacttgatccgagctttgacaaattcagtttggaactttggatgaatctgcaattctgacgacaaaagggaagggaaggacaaaaaggttttactttaatcttctttcactcaatgtctaaagtgattttcagagacatacaatgggctttatatctttcttttactcaacatctaaaatgatattcagagacaacacaatgggcgaagacctgtatttatctctgctctgaaagactgaaacagtctctgctccagctacgaagactgtatacttgctggtcatacagatccaggatgtgtattatttgcaaattcatcagaaagcatgactcaaccatcacacacactcacacgtaccatctgtcatctctttcgatgatatcattcaacagggtgacaaactgaaaacaaagaattgcaagaaagattggaatgaacacaacaggatgacccagg

SEQ ID NO: 109367 - DNA, 936 bp, Oryza sativa
tgtcctcactcatagcgttggcggtggcctgcactgtcttggagaggaactgacaaggagagtgtgtgaggccatgaaggaggctgcagtgaggtcggccatgcgggtgtggaggagcagcgatgggaggagtaggaggatggggaggatgccgacggtggggaagatagggaggatacggaggtaggggaaggggagggtgagaagagtgggaaggaggcggaggaagtggcgaaatctaccattggagacacgagcccgactgatgttgtgccccgttgaccttgaactcatcatctttgcctctaaggtccacgtcgtgaccgctgtgcattcattgttccatgccacacagcttcaatcgaatctgggttgagttggtttggagctgaaggggagcaagcgctaggatgggaggtgggtgttggccacaatgaggagctcgtcggcgctaggaggggctccatgtccaccgcgcactcggacagctgcttccagccgacgcgagctagtctgtcgctcctgcatatcctcattggcaaggattggagggagggcgtggggtttgggaggacgatggaggcgatgaacctgcccccatcgttgtcgccgccatcgccaatggcttcgtcgtcggtggcctagaggcgcgacttcctcgctagacgccgcatctgaaacgaggtggagagatatggtaagaaagaagaggggaggatggagaaagaagatggaattgacatgtgagtcccacgtctaggggttttttttgtctatatgatgacggaaaacatgatggtgatgacatggtcttaattttgtgtaaattcgaatgacatgaaacgaatagacgaattataagtagtatttatctgatcagcatatttgtactggaatgttccaattaatcctttattttatgggacaattgatcgt

SEQ ID NO: 109368 - DNA, 2231 bp, Oryza sativa
agagaataggaacttgcaagggaattaaatttttgaagttttaccacatgttatctctttgtagtgtaagggcttcaatcctttctttactaggtaaaagcagttgtccttctccccttccctcctcctatcctacatattaaaaaaaaaccagtgaaaagacaaactgaaaccaaccgaaaaaaaaatagggtggaaaaaattgaaccatgtttctcatatcaaattaaatcacgttctgaaaatcctgttgcaacgtatggacatatgactagtgccatcagagaaacaattacgaaactttcttgcccttttaaaaaccatagggattctaagtacatggcacttaaattcctgtgtgtgtactaaaggtgatctaatatgattctccattacacatttgcacgtacgaccgtgacaagtcatctcatgcatgattgatacaaatcaaacaaatccatgaatgtgatccccattccatgacaacatatatactccctccgtcccataatataagggattttgagttttggcttacaatatttgaccactcgtcttattcaaaaaaaaattgtgcaaatataaaaaacgaaaagttgtgcttaaagtattttagataataaagtaagtcacaaagaaaataaataataattctaaaatttttttgaataagatgaatgatcaaacagtgcaagtaaaaacttaaaatcccttatattatgggacggagggagtactagatttgtactacttcagatttcctaggctgagtttagttccttccaaagttgaaagtttgggttgaaattggtacgatgtgactgaaaagttatgtgtgtatacaggttgacgtgatagaaaaagttggaagtttgaatccaaagtttgactgtttggtagctagccagtcagccagacacggttttgttgagtcctcaatcttcatgcattccaccatgatttgatagccgaacgattaatggcgaaaactgataaaattcaaacggaatgtatcaaatatttggattttttaatacatgaaaatttatcaagtggttcttaaatatagattggctcgataagatcaaccatgacagtcaagcagtttttgttgtattatgaaatcctattcatctctcatgctttcaaatctatatgattatttccctagcaaaacaaatagatccgtcctaaaaaggaattattcccatttaatttgaaaatgattctgcatgagttctgtaaagaattttgtatcgaccaattcaataatttgaagaacagagtcacaaagaattttcctgtattctactctgggccttgcatgcatcacagtgttagaaatggctttaagcttttgcatcctgggcctccaaaattagttggtttaaaagcaaacccacgtacctaattaaaattgggccgcccttgttcacactgcacacttcatgctgccgactacaattaggttttgtttaagagaacattgactaattatatttgtgattatcaagaaaagatgtactgcactatgcacatgggtcacattcaaacctgatcttccatttaagattgagaagtgaagtgattagttcctcttgaattgcatgatcacctcaactacaactaggaacttttagtttgagaggtagtacaaattagaaacctaaacggctagaatccaccccttttgcaaggggctagattccacttagctccacacatcgcattaacaaacattaattcacatgaaaagcaactccatcggctcaactaatctgttctttccgttccattacatatgaactaatattgatcaaggctaaaaagcaggctatatttttatcttacattaatttgtttgtagtaggtatcatgcgaagcaaaactatagtatacatatgctcatgggacgctaggaattgcacattgacctaaaaaatattttaagcctgaatctctattgagatcttgtcattgattatttggggccatttggttgaaacacagcacaactttgtcaagaaaggcaattcataaaagcaaaagtaaacaagtgaactggcgcgtcatcatccacaaatctctgttttaacttttaattagtacgtaactaacaaaaaccaaagaaattattacattaggacatgtacagacagaggaatagtacaagagatgtgagactttcagaaagtacaggaaatgtgttgcaaataaaagatctcagtgcc

SEQ ID NO: 109369 - DNA, 853 bp, Oryza sativa
ctatagctgttgttcttttgtcagacgtagtgcagtgacatggctttcaacttttcagtttgtgaagcacctttctgttactgcacttttccagtcctttggacattacaattgtacgaggacaaacctgaaaaagaaaaggaaaaggagatatgagaataatgcttattctcaatataaaaagcaagtcatatatagctggtacaaaggcatatgattcatgtgaagtcgttggggaagagaacaaaagatgaatcatccctgtgttcgtctgaattgtatatgtggtttgcacataaatatgtcgtcatttcttgtaccgaaaacaattggacaaggcgacctgactaaaagtttttttgaaaacatgaattgaagctagaagaggacaatagaatgatttcacatgtcttgaaagtgtttaagtgatacttcgtattttctctagtctctactgttgtaaaagtgcaatcgtcttttttccatcccctccttctactgcgcgcgcaatgtgtacatccgattttttttcacatcatatgcctaacctcttagctcatccctaatcgaatggacctgcacgttgtaaggtttgaagaactacgtacaagtcaggattggtttgaagaagttgttttctccaagtaagaagtacacacaaggttcttccatagaagcaacgtccgtgcaaagattgacttaccatgtgcaagatcaactctgtgcaacaattctttctgaaagcaattgctacaatcctttttcttccatttcacacgcatcatgcttcatgccatgtactccctcgtcccaaaatataaaaacctagaactggatgggacgtgctgtccaa

SEQ ID NO: 109370 - DNA, 1144 bp, Oryza sativa
agttctcaacctccaagagtaacaaacaccacacaactcttggtcaaaccctatgctcaagatcgagtgaaacacacactaggccctcaaacaccaaatccacaaccaccaagatccaccacacaaagaacaaggagggatttgagagagggaggaagagctcaaagatccaaagcaccttagcactaagctcaacccaaagtgaatgagaatgaaatgagttgggtcaccctagaaaagggttaggtggggggtatttatagatgccccaaaatgtggccgttggaggggaatctttcagcccacgtcggatagtccgatacaagatcggatagtctgatattttaaacctccaaggcaacgagaaacagagaatgaagttccatgaaattttggactttccgagacattggactatctaatgttaaattggagtatctaatattttagaagtaaaaacttcgtcctcaaacagagacttaagttctatgaaatttcggagtctttgtatcatcggactatctgatccgacatcggatactccgatacttagaaaaactcattcgataggattttttcaaatcaagacagttctgtgaaaaattggatagtccgatacatcggatagtctgatttcaaatcggatagtctgatgttgctcaagtaaaaatgcaataactttttactccgaactccgatttcgaagatcttggactctatggaaagctagtttcgtgggctatcaaacccaacataaaacatggtccaaaaccttcaagagattttgaaaaacttgcaaaaaaacccggtgtaagtgttgtgacgagtgaaacaactcgggattgaaattttggcttaggtttttcaactcacacaaagatgaagcattttgagcactagtgttctaccaattatatgcatgtggtatccctcttaatagtacggcattcctacgacacaatgcaaggtaaaagatacaatataacatttgatcattgccgcattgcatcttgatgtcgcattcatggggtatgcatctcattacaacatgtcgaggacataacaaccttcacatttgcttgaataaaagtgttagtcctctctaatcgcattgtaatcaatcatcaaaattattaggggtcta

SEQ ID NO: 109371 - DNA, 1507 bp, Oryza sativa
tttctgcacaaaacaaaaaatggggttggttaaatcattttctgaattaaatttgttctagtattccctagtgggaagatgatgattagaattgctattgctgaattaatagcacaataggtcatcaaaaggacataaagcatttgtgcaatgattaggattcaggtgacaagaagccggccttaattaagcttttggaaaaggaaacaaaaccacttgggagaagaaaaaaagaaataaaaggaaagtagccaacatgaagaaagatcctacaaataatttgtctgatcataaattggatgtatgaatgattggagtccatgtggcatccaactgtggccaaatctattcaagaccctacaaatatgtcatactagtctgaaatagtctatctgatgacctatttttaaggataactagtgcaacccacaatattgattactaatgtgatgctaaaaacaaaaaattacaaacaacaagttgaacatatatactccttaaacaagcgcaaccattgacaaacaacggccatatatagaattttctgaaactgagaaaccaaacattgtctgaaactcatcacaaattcagaagccaaactaggagtgaacaaaagactatgtcaagtcatgccccatttgccaagaagactttataggtagaatagattgactgctaattaagttagattgtgatgaaacaagatggacttgaagctatgactctcactagccgtgttgaccaatctgcctccaaacttgatggcttcacactaacttactcaacggggcagtgtaaattgttgggttgtttttagcagcctaagctgaacaattttttcacacttgacgtatttgctgacagagctatactttgatccagtctattaccatctccagactttgaattttgtatgtggttatgtgtgagctcttgacctcagatttttggaatttttcaaaaagttatcttctagaactacttatttgtctcattcatctgttggaaaaatgggttcttgggatggaactgctagctggcaggaaaacgtttaatggcagaaaatcttcagcatatggtggaaatacattcatattattattgttgtttttcatttaatgttgaattcacctttcttatttgtgagggaaaactctataaaaatggagattaaagtgtactgactgctatgtgcgagctattgacaaacagtaggattttcaaaaaggttaacttctagacaactgttttctccttcatttttggggaaaacaagttttctcaggatacaaaactactaattggctggaaaaaaataatggtggaaaatcttcagcacataatagaaataattcctatattatttattgtttagtatcaaaataacttttcttatttgtgagggaaaactctacaaaaatggagattaaagtgtggtcattgtttcttaattttcaatattttaaattgcgattctgatctcaagcgattcacaaagaacccaaca

SEQ ID NO: 109372 - DNA, 572 bp, Oryza sativa
gatatttttatgagaaatggaagaaaaaaaagtgaatgtgtagaaaatagactcacaaggataatataattaatgagtgaaaatgacttacataggatatgttatataattatttcatccagggttttcacattgcacttttatgtaacttcatatcaaccatatacgcaaccaaaatgtagaacttgcttacttagtaagcattcatgcaaagatcctacttaatgaccctttgtgttgataagaatgtattttttccgatagtagaaatctatctagtatgtacccccaaccgttgagagtttctaaaaaaagatatttttcatgacatcaaagaagttcacaacataactatatattttccaaaatacataatttacccatgtaaaaaaaattcaagatctaatataaagaaaaatcgatcctatcctcatcagtcatcatagtctcattttttcgcttatactaatacttagtagctaaaattcaaattttcaaccttgaatttataattggtttgaggttttttcatctaagtttatttttcagccattgcttttaaattgttaaga

SEQ ID NO: 109373 - DNA, 733 bp, Oryza sativa
tgatgtacagtaaacattctctaattatggaataattagacttaaaaaatttatctcgcgaattagtttttatttatgtaattagttttgtatatgtaattagttttgtaagtagtctatatttaatactctaaattagtgtctaaatgtagagactaaaattaagtccctagatccaaacaccaccgtagacacgaatcaactaataccgtagcacacctagatgcagatgcacctagtcatattctctttctcaacacatatctgagcacctctgttggcgctaccctccaaaagagaattagaacgcacagcggagtgcagaagggtgcaccgaagatgatcaagtagacaatgttggagatgagcaggtcgatgccgatcggggctccaatcctgagcacgaccctgatccccatcctcctgcgcaccacgtgcgcgcagctcaccatcagcaccagctccctgttcctgaacagcatcgtgccggcggcgagggcgcagacgccggcggcggtggcgcgggacaccggagccagcaccaggtacacccccagcgcgaaggccaccagcaggctcctcatcgacaagcgcatccaccacacggaattcttgaagtacctgtgccggacattcatctccaccgccgccgtgccggcgtacatcaggctgagcgtggcgagcatggagcaggtgaaggccagcgccacggcgtacatgaacgcgtcgaagg

SEQ ID NO: 109374 - DNA, 708 bp, Oryza sativa
gaacggtcaaatatgtgctaaaaagtcaacggcgtcaaacattttgaaacggagggagtactattttaggtgactgaaaattttatgtgcctgaaatctagccattcccttctttgtggcaaaaccatatatatctcttgcaacggcggtgggtttcagatccatcggaatagtcaaattaacatgtcacaatattcatacgtgtgatactacgcacgaaagtttgaaacagacgagcactcgatcgatcgatcgatgaaatcctgaccgttgatgcttgatcgtgtggatgtacgcccgatcagcctacgtacgtgtgatcggcggtgtgcaaattagtcctcggaatggctcgcgcattcacaaccagcactgggatgcacgcacgtactgcgttacacgtctgcattcagttgtggaatctttcatctaggaccttacttttgagatatattacattcagattcagttctttctctcctcctttctcaatttcttctccatggttttttgcgcgcgcattttttaaattgcgaatcaatgtaattttttataaattatagaaaatttgttttaaaaatcatattaatccacttttaaaattttttaaattaatacttaattaattatgtgttaatttatgcttcgtttacatgcttgaaggattatttcccaaactggtaattcttacttaccttagtagttaaa

SEQ ID NO: 109375 - DNA, 647 bp, Oryza sativa
tgagagcaagtataatagtaggctataagcaggctaaatgttgaggtggaggagaaaagagagaagagagaggagaagcgggctataaacttacagccggcttgcacacaagaaccaagaaactctgtgagagagacaagtgggccctatattaattgtaaagagctaactattatatgggtagactaagagaaggctataaataaccttatagccaacagattggctgtattattagccttgctctgtcagggtgaagaattttaccgaggatctaaactggtccatactctcatgcataatgcctttttggttgtaggcttggaatttttaataatttcatttaatgagctcgttttggaactgtgactgtcaacttgaaattggtccaacacatagccagaataaattggaccttttgctttcaaattattttgttaacctggacgttgcactttctagtggccagtttttgtgcagcccataaaggaaaagttgaacaagtgcggttggatgcctttgcataattggcttttcttgtggatgagcctacaaaagaggtctttaggagggcaaggcatgctcgtctcatcatgtgattatatgatctaaagaaaaaaaatccacaaacaattgataattttaat

SEQ ID NO: 109376 - DNA, 797 bp, Oryza sativa
ctttgtttattgccaatgcaatttgccatggctgtggtggcggctttcaagtaggatagataaataaatgcatggaagagaatgcttatctttgactcgaattatatatagattagtacctttcaattttattgttaccacttcactacctacctatagtgagctccagtgctggaccgacactttcacaaggtgcactcttgtttcagtacttttgcatatttttcttcggaacaagacggatccgttctaaagcgatgaacgggtacaaaatgaaatggatgattcaaactcgtttatataggggtagattaaaaattaataagctcgccaaactagcttgggatctaaacaatacagtatagaagatttcttttatataaaaaaatgtattttgagaagcatgaagcaaataatccacggcaataatctggtcataatatacataaacgcaactactcctactaaattctaattattggtagtttgtaaatatcaatctcatcaatcaatcattcttcagtttctgtacgcaatgcccaattgcccatcaaatatttttttcttttttccccttccttttgttatccatttattttcttttttaatatggaggagaaggtaataacaagaagctggcatataattggattagggcagagagaaacgtgtaggaaacaatgcgagaatgattggatgagggcacccaccgtgcaatgcatcacgtggaagcagcgatattatcaggtcgatcaggaggacgatgacagtgggcccatacaaggagtggggcccac

SEQ ID NO: 109377 - DNA, 787 bp, Oryza sativa
tggttgataccctgcattttgccgcggtacatgtggatgaatacatacatgtttaatatgtgaaataatatggagataatgatttgacattgattgcatattaagttctaaaaatacaacaaaattgtaaacgatatatcatatttgcatgatatttaaaatactctagataataattgctagtgggtaatgatgtggcacacttgcatatgatttaaaatactctagataataattgctagtggatgatgatgtggcacacttgcatgttgagatttagaagttagtagacatcaactttacagtaaaattgaatatgataagccaaaacggcctattaaggaatataaaataatttatagataaaacttgtatatatttgtttttaagtgacttaaaagctaatgcgtaaaaagaaactacgttgaaaatatcttaaaataaacttcaaaattaagtttaaaagttcaagttttgtcttttgctttagcttattaggcgaaccgatgggacctgaatcctctagtgacctaagtgcagggagcaaacactatattacagagtgaaaatatagagcacacacatctttagaagctgttctccatttcatagacatggatcctctgcaatactacgcctgcagtcccagtgactgacagatggatccagtcctacatgttattgttacagataatctctacagatttctattatctaaggatgtggacatatctattggtcttgaaattacctgagtgcagagtgcaaaccctgaaatgttcccaac

SEQ ID NO: 109378 - DNA, 506 bp, Oryza sativa
ttctgtagctagcatcaagttaaaattggtgccactaacctcttacacctcaatacctgctaccattattatccttgaaaaacatatcaaaaacttattttcgctacgttagaccgtttgtaggcttaacttgctagtttattcgcgtcagttcaccaagctcatttgaccttttacctttagtaaagcatgaagccgcgtacccattgtatatgtccttacgacttcaaatagttatatgtatttctagcaaacagactcataggtctagtcaccgtggagtacatacttacctctcttgaagttatgtgggtttgattccatatggttgaaaaaacaaatctgatatgggccatttttcagaaaatagttgagtgggttcttcctatagcgtgaatatatatgcttatacgatgagcttaagatcactttgtgtaacgccccccgtagccacgtacctggagtgccacactaaaatacactcaaaaccactaactcccaaaatt

SEQ ID NO: 109379 - DNA, 838 bp, Oryza sativa
tctcgttttgcgtgcccgcttttaatcttcatctatagaagattcaaatggggccatactgcgctataactagtctatatatattgtcatgtgacaactcggattattgccaccaaatccagatctatatttctagtctttaattatgtccttaatttaagattagttggaatggtgtggcacacataacaaaacgtaagccacatccaactgttattattgacagggtacatatatataactagatgacaccttgcgctttgtcgtgggatatatgaatgaaagtgtgttgaatgttgtataaatgattggtgaatttggattgaaataatttgaaaaatgatttgaggatgatgatttagcgtgtgtgtatacatttgagtttagaatgtaataaaattgtaaatataattactatgcttgcatgttgagctttaggtgtttagtagattgatgtggcatgcttacatggtaagttttaaaagtactaataaataatgcttgcatgttgagattgagatgtctggtgggttctaactttatatgaggtcaagattagcaaaggcaagatttttgccacctcacaataaatatgtgtgtagttgggcagccatttaattaactagtttttcacatatatattattgctattttattccttttcaactaggcttgtgcaagtaagtgttactatcgttaagaggttgtcatacaattatgcacacggtggtcaataagttagatacgtacgggtctctaatgaagtagtataaaagctagatccaattggatatataatataataatacaaaatgggacctggtctgaggtttgaagg

SEQ ID NO: 109380 - DNA, 510 bp, Oryza sativa
gtacagttgtgtggaccgtatgaactagccggcactataaaaaaagctcaccgataacgaaagatacaaaattttcgattgggataatagaggcatcttccttttaatttaaaataccaagcgggaagtttacttgcttgagcgcatgggtaaaatcgtctttttggcgcttcgccatcgagtagtagtatagcttagctgccagctaagcccacagcttcgaaatttttgaaattggagcgtgcgctgcgctgggccgagccaagagtgcgtgaagaagaagacgaggaaaaaaaaaagaaaaaaaatattatatatatatagtactcgttttgttttttcccaattcagtttgagctcggagtactaatgctggccgcatttgcttcgcgcgaacgccacctgtcaccaggacacccgaaaagctactcgtacgggaacgcatctcctccctgcgccagtggggcccgcatgtcggtgagagtaagagtagtcgggtgcgcacgcgcc

SEQ ID NO: 109381 - DNA, 831 bp, Oryza sativa
aacttatttcaaaaacaaaaggagagagaagcaaggtccatcgcttgggccgacgtcctcccccctttccttcttacttgggccgacgctcccgcacggcccaaggccgcgctagcccatccccatgccgaaccagctagcccaaggccacgccagcccagcttgcccgcgcccctccttcagtccagcccactcgtcaattttgtccccctcctctagcctagtccactccctcggcccgtagagtaaaacagaatgccaaattagtgcacgattaaggccctatttctttcatgttaggattattataatctagattattgagagtaaactgaaagaaacagataatttattaaagtagcttattataatctggatcccagcttattataatccgataagctcatttatgtgagctttttccatattattgggtgaaaaattacccaccatgccaccccactccttctttaaacttgtaaacccaataatctagactctaataatctaggaaagaaacaactaaccgcctattctactacatattatagcttatagtaatctgactcaataatctagattataataatcccaagctaaaagaaacagggtctaaaccagaatgtcagattagcgcacgattaactaaatattagcttaaaaactcataatataaattaatatgatttttaatgaaacttttatatagaaaatttttttgggaaaaacgattgaattccattagccgataggcgaaaccgaatttttttttttactaggagagcattgcaggcgaaaccaaacttggctttgggttttcctccctctcga

SEQ ID NO: 109382 - DNA, 1042 bp, Oryza sativa
ttgatggttttggcctaaccaatttcggtcgtctgagccttcagcacatatgcctaaaccaggcaattgattagggttgcaaccaaacattactctggcagctctcaagcagcagtccgttcaggcaaatttggttcagggtagcaaccaaacaccccctaagacctgcaacccaacccatatttccaactcaatcatacttatgttatcattgtcgcacattgcaattatcgactttataatggtagtgatgagattaattggaagagcctaatagaattagagcaaccggtcatacacacaattagatggaaccatccactccatcaaatattatcgttgctcttgatttaactgagaccggtcgtctagcatagggttaggatctccaatatgatggctcgatgagacttctcgatttaacaaaccagatttagggcccatttgatttggaggaaaaacataggaattttagaggatttcaaaaattttctatgaagccctttgaaacaaaggattgaattctatctaatcctttgaaattcctatggaatgaacaatcctatagagattttggaagaaatttagcaagagtttcaacctcttgctaactttcctttgagtctatatctctcatccaattcctgtggttcaatcaaacggtcattcctgtgttttttctgtgttttgcaatcctctgttttacacttacattcctatcaaaatcctacgtttttcctattcctacgttttctcaatcctgcgaccaaggtcttttcgctacaattgtatcatattgatgtaattgacccattacaataaagcttctttcatctgagaaaaaagagatattttttgagttgtaaaggagagatggagcaaaggtagagggagatagctgaagagatatctgaatctgcaggaatctgaaaggagagcagcaccacccaagggcaagctgagagaagaaaagtgtgcagtgtagtgtggagttccctccaaaatcactggctaccccgccacatcctctgccttccactca

SEQ ID NO: 109383 - DNA, 542 bp, Oryza sativa
catagtacagtgcactaaaatcacatgacaaaaagaatgaaatattacaataactcaattttttttgctagaacagttaaagatctacaagtaaaaacaaaagatattccattgagaaaaattaacctgtcaaggcagaatttttctctgtttcatctggtggattaataggaacatgaccttcaatgataaataggcagaaacatcaataattcatatttaattttttttaaaacagattaacaaatctagaaaaaaaataacctgttttgttcaacttcttcattatttcatcaatgttgatatatttaatctacacaaataaaaaatgacagttaaaaactatcaacaattagagttctatctattcatattataatgattgaaataaaaatgaaaaaaaaacctgttctgaagaattcaaattggtagactattcacaggattaaattcttcatttggaattggcaacttgtcatcatctagtactgttttactgtttccctacaaaaaaaaaataaaaggacaaaaaatgtttaatg

SEQ ID NO: 109384 - DNA, 678 bp, Oryza sativa
gaaccacttgaatgcttctttgcccttgcagaggagagagataggcggaaaagcacaagcctactcctagaaggtttgtaccactaatgctctatgaagatatgtttgtcttcagacatagtgtttcttagttgtttcttctgctaaattataggttcaaggagagaggctgaggataagatagttcctagagaaatcgatgcagatgattctgatgtggaacccagaagtgatgatgaaaggtctgtcttgcactcttgttcaatcttttataaatcaccatgctcatgtaaaatacaggtgacattcttgtggctgcattagtgtgcttatctccacatctttttgctgaattaataattctggaggaaggtagtttgggttgaaataattttgtctgtcgatatatactgtaagcttggttttggtcagaaggctagtgaactagtggttgatatccattcttatctagaatattttgttgattgtgtccactgtccagccatttttataccatttggataaatcatgaagcaacttactttccatttttagtgcatatagttgcgtgtttggattcacatattcttgttttatagttgaaaattgcaaggggtatgcggctttaaccccaaagtcccatgttcaatcccaacatgctcacaatttcttcttaaa

SEQ ID NO: 109385 - DNA, 1101 bp, Oryza sativa
acgtgttgtaaaccaacgcgcctattagcggatcaccggatccgttccctgtccctcccacagcaatagagacgtgagatgatgtacaacacccgcgcccatccctttgtcttcaagaacattgcagaagtagacaatgaacacatatatagggtggagctctctcttcattatagatctcatctggagtacaagccagccattaaccattagatgtcacaccctgcccctgtatatatagaggtcttacgaggagataaacattatctctactccggttcagattggcccacaagaaacttatccccaagatatttgtttcacaacactttgttctggtccccgattcccgtatccattcggccccgttgcctttgcattcgccattggatttcagaatccgaatcccgtctccttcctttcactctgtctcaacacaatctatacctctttctttctcggtctctccagtaccctactctgccctgttcttttcttcttctctctctctgctctgcctctgtcttgttttgctttgcttcttctcgatgccatcgatgcctgcatgactgcttgcacctagcaacttcctcttgccaagaacgggcggtcgcagcaagtaagttagcctatctagcaacttcctcttctccattactccctactcctttctgtttgtttcattgctttcttccttcctaatactggagttgtactagtctatttccatctcaacatgcatgattcccagagagttctttgcttaggttcacctaccgattaatttcttggatactagctgctactcgtattatatacagagtagtttgttgattcttctcacacaaaaaaccttacctgctactagctactagcttcttctggtgtggtgtttaactgtttatagagtgtccttgacgtattctgatagctccacctgtcggcttgaaatttctagaggaaactagcttaggtgtcacctgttgctgcttcctactaacatgaagtctctagaccaaaagaaaaaaagaggagagtatactagtcattttgctctatcaattttactatttacgtgatcacacaggctctccatacaaa

SEQ ID NO: 109386 - DNA, 1464 bp, Oryza sativa
atgcaaagatcaaatcacccgtccagtcagtagagggttagtatatatatgtaaagtctacatagaagagtagaaaagtattaataaggattcagtggctgcaaatattttgaattcttgaatcatatagacaaatatgggtaacgagacactcttatttgagtctaataattgtgcctaatattttctcagatgattatcagtttgcagatccaacttgttgaaaaggcttagcagctttgacaaaggttcatgtagaccagttactgggaaagggtcttcagtcttatgcacaattaccgagcaaatcaacaaagttatgagaaatgtgaaaaaaaataaacttcttatgagctgtattttatagctcaacagtactgccagtacttctgtgtaagattgactggataatggctgcaatttaaggtcaaattttacatcaattaagcatttcacccagatcaagaccagtcctataaatctggtcttgatctgggtgaaatgctggaaaaatatttggcccataaatctgaaacaatgttggcccagttttagatggctatcggtatttcgaatacaaagtccagctatgttggctttacagggaacaagtccgaacgtaaattatgcagttaacccacaataataaacatacaagtgtattactatggtttccccaaaaagtggcctgtaaaatgccatggaacatatagtattcaccatttgggaaagcgaaaataaacagatagttgatatgtatgactgatagcatatgttcatataaacaccgatagcacaccttgtacatattaacaatagcagaaacaataggtcaaactgtctttaccatcactgcatgggaccaacgaaaatggatttccagattgaaactacaaagcggtctttttgtttgaagctatgggaccaaaagcccagtgttctcgatgcaactgtatgatgaactgacaataatcagataatgcagttacatatgaaactacaaattaagagctcacctcgtcgatcggcactgtcaatcagtctatgacacaagtactgctccagttatctccttcctagctatcctgcacctcggcagcgaactgcaggcatatctacatgatcatgacctttgaaatgcagcgatgctattagtataactttatactgagattttggagtcttttcatcaaccgattaacaattgcaatatacaagtagaaaatcatgcttatttacctttagaacaacggtcatgagccactgaattaaattttctgaacctctcttccaatcttccaaatttttttctattttggcttctctctggttttaactttttatttctctttccatccctcaatttttttttatgctccttcccctcccttaagggtggagctcgtgactcccatcctctcgcgcacgctgcgtagtcgtctcccagccacaccatacaagctg

SEQ ID NO: 109387 - DNA, 1142 bp, Oryza sativa
caagcaatgtacacacattgcatatccattccatgctcaaatgattatcccataattaccttcctatagcaacaggtaaaaggaaacaagaagcaaacataaaattcttaagctcagtttgattttagaggaagagaatgtatgctatgcatgaactatatatacagtatgtgtactgcttgtgcactaggctcaacacacaactcgtccaatgtacatagctgtacactgctggtagcttctacagggaatcaacggctagatggaattaagaagattaaatttatcatacatgcttggcagggaaaaacacatcaatcgatcgatcgacagggcatttaaaacaatacatggatgtgcctaaatcatgttcatcaatgtagcattcacgaacaatccagtggatgtttgtagtacagtcataaaaagagactggctcccacagctggaactgcatgcctttagaacatcatcgatcgtgcattatgtacatatacgtgtttctttttctttattgccaaatggtagtacagtacacattgagtagcttgttgtgtggcttaaaatatcactcaaatattgaaattttacaatagaaactttgcaaccctggccatgtgactaacgatagaggttacactgggaatgtaaattcatttatattatctaaatagatgttttaaggaggtctccatttattgaatccatctaagcatttctaagcgttaaattttctagtgtaatggatcatatgtatattaccaccttaactactggcagtggcgaagctatactgttcttggggggtgcacatgaaccccccaaatttctaatttctcactcaaaaacagtagaatgtacagtgttgttttgaaattttctagattctcaatggtagtgcacccctcttgttttgatgctagcttcgcccctgcagtggcgaagctatactgttcttgggggtgcacatgaaccccccaaatttctaatttctcactcaaaaacagtagaatgtatagtgttgttctgaaattttctagattctcaatggtagtgcacccctcttgttttgatgctagcttcgcccctgactactggtagctatatatatatggtactccctcggtactggtaaaggaagt

SEQ ID NO: 109388 - DNA, 818 bp, Oryza sativa
agcatcatgcgccgcgcggccgcggtgaaacgaagaaacgtgcgccgtgcgcgccgcgagaccgcgcgcggcgtaaccgaggccagcgtacagccagccacgcgccgcgcgccgcgcgcggcgacggcacgagcgggcggctgcgcggtggcgcacgggcggtttgacctccacgctcgcggcgcgggcagcgactgcaactgcacggcccgccgcggctaagtccactcaccgtgccgtgcgtgatggatggatatactccactttgcctgtacaagtgcggctaaggccattctcaacccatgacactagacatagtttctgtaagctccacatcatcaagaaattagtactagacactactattccaatgtaaatatcactaatccatacttcaattaatgccacttatctcacatgatgtcttgaatgttgtgtagaaaccatgtgtcatgcaagatatgttttccttctcattcctcatttattcacttgctacatcatttttcattttaggtggcagcttatttaatgctatagacaccattctagtcattgggttgagaatggcctaaggccttgtttagggcctgtttagtttatgaaaagaaaaattttggatgccacatcggatgtctgaagggttttttcggacacgaatgaaaaaaaataatttcataacttgcatggaaaccgcgagacgaatcttttgagcctaattaatccgttattagcacatgtggattagtatagcacttatagctaatcatggactaattaggcccaaaatattcgtctcacgatttcctccctaacta

SEQ ID NO: 109389 - DNA, 594 bp, Oryza sativa
cctgtatactgtctagaaaatactttgtaggaaatctttaatctcatgcggcaattgtaggtcttttttgaaacaggctacttcctccattttatataataagactttctagcattgcccgtattcatatatatgttaatgaatctagacatatatgtgtgtctagattcattaacatctatatgaatgtaggcaatgctagaaagtcttataacctaaaacggaggtagtatatttctgctagttgtgtcaaatcttccatgtaaagtcatgatagccaaaacatgtcactggtatatttcaattttttttctgtgtccactcatttcctgttatgatcttaagggcagtgcttgtctgatgttctatgccatatactgagcgaaaactatttagttatgtcaaataaaagtgcagcaactacatctgtgaattctgtttaccttttttttttttaaaaaaagtagggagacatgttggtcaaatttagaaaaactctatttggagaaatatagaaaatatttatcccatcataaataggacaccggtgcatcctgtgtaattttagtttcgttatcttctctctttagtccc

SEQ ID NO: 109390 - DNA, 1455 bp, Oryza sativa
attggaaatggtaggttgcagcaatgaatcatcagcatttccaacttcaatttcttcttcacactgtgatacatcattaggtctgcccaatatcacagaagtaccatctggtgcaaagtttttatcatcctccaatgagtgaaatggtttttcaataaaatcattgctttcgatagaggaacctgacatcacatgacaataactatgtaggtaaaaataaatataagaacaataaataaaaaaaactaatgatgtttttatcatcctccaacagagggatcatatttttgtataaaaaactagatacttagaatgtaagaattaccatccaagccactagatttctgggatgactgtttatcagaactatgggcaatcacagcatgatgatcattggacaaagatgcctcctggtattgttgaaaaccattcatattaccattggtcctaaaaacatcattgtcgtcagagaatacactggatgatgagctgacatccatttccattaggtcaacatcattagaaggctcttcatcattggtgcaatcaacaccactgaaatttgtattagaagatattgcatggtttggttctccaccattgtatgaatcattcaaccatggtgatgagtctattacatgacctagttctgaaaactctgtgtgccgttcattttcaccttcatcgcggtgaaagttcaattcatccaattccatcttggcaccagggtccttttttattttcatctcagcatgtgcttcaccctctgattccatgttattaagagcgtccacgaagttctcctgatcactaccagtgtcatcaggtctgcagcgatcatcattttgatcagcagggaccatagctgatagaagattctcttcctgcactgactgcatcctatcagagttggagagcatggcattttgttccacaagagatctcttacagacgtcttccactttgtcaggttcatgctgtgtagcctgtaattgcctatcatctgcctccagggcctccaggcaatctgaaccattaatgtgtgtaggtgcgatccccttggtatcaaactcgtttattggaacaaccttagtcagttcaagtttagcagaagattgagcacgagcactgaaattatctatttctccaaatgaggatgccgtttcacttgactcagttaatctaaactttggatggtagtacctcgaagaatagttggagaagatcttttgttgtgatgagattatttcttgcagatgctctctgcatattctgctaatgttcttatgatcagactcccgaggatacctgtatttcaactttgttgtccttggtggaacttttctagatgatcgatcctttgaggtagtgtgggatctgccgatttttacacaaaatgatattgtatcactacatgatttttgtgattattatgtacatgaccaatcaaaatgc

SEQ ID NO: 109391 - DNA, 978 bp, Oryza sativa
caaaagtgaatttaaatgtgtccttcctataaacattctagtcctccaaatacattttagtgtccaaagctaaatttaaatttctgtcctccttaaagtatttatgtccaaacctataattaaaattttgtcctacttaagtcctccataattattttattgtgcgatgctgtcctgtttttcaaatcaggcgactcttacggttttctaaaaatcaggagacgcttaggcctctttgaatggcagggtagaaagaacggaggaataagaaaaacgcaggattcaaaacggaggaataagaaacacacaggattctgatagtaattgaagtataaaacagaggattgcaaaacacaagaatgatcgtttgattggagcgtaggaaaaacgcagaaattagatgagagagatagactcaaaggaaattttccaagaggttggagctcttgctaaatttcctccaaaatccacatacaaggaatttcataagatttagaaagcttcaatcttttgaatcaaagggccaaatagaaaaagattcctataggatttaaatcatatgaaattcctaaataaatcctttgattcaaatgggcccttaggctgcgttcgcttgggtgtgatatagggtgagaaagcacctcgttttccacgcgcacgcttcccaaactattaaacggtgtattttttataaaaattttttataggaaagttgctttaaaaaaatcatattaattcatttttaaaatttaaaatagttaatactcaattaatcatgcgctaatagctcacatcgttttacgtatcttcccaatctcctgatctctttctcctcaaacacacccttagatttcgttggtcggtttgagccgtttcaaatctggtcttccagcgcgacgctgcccgcctcgccatccacctccacgtggcggggtgacgtgtcactccgaccctttatcaaaagtcgccatccgatat

SEQ ID NO: 109392 - DNA, 609 bp, Oryza sativa
gatggtaatattgtattgtattagtgtataaaaatgcctatgtatgttcaatatatgtgtgtgtatatacttcacattttagattaaaaaaacccttaaaaccactttaaaggtcgctttccgcttaagcactacaagttgtagtgaccgcaccacaccgcttaccgcttttagaaccttgctcccagctgatgcagaattctggtgtagggttgttggatcatttaggacgtgtcttgagccccaattctggtactaccttttcacacattcacaaagctcaccagtcagcaagctttctctgagatattttatgtcatttgaacaatgccaatgcattgtgatggttctcaaataaatacaccggaagttctgagtttaagaaaagaaaaagaaaaccctctagtctagataatttcccaaatggcctcggttaggggatttccaggtaaggatcatagtgtgtagctgaggctggtgggatgggagggagggagtcctgctctcaagcttgtggagaagccatgatggctggcacaccagccgtgtggggcacaccctttgctgtgcgcctaccactgtaggtgtggacccacatgacgcaaatat

SEQ ID NO: 109393 - DNA, 620 bp, Oryza sativa
tgagaaaaaagcgatccatcttgccgctctgtttctcgactactgaggtctgaggttttattactactacagccgtaggtacagcatacagtaagctgtttggccggacaggcatgatgatctctagtgagaatgtgatgacaatgcaattcaaaacaaaatgatgcatgccatgatgcaatgcactcatcttaggattaagggagatagaagaggatctggggacgaggggttgaggcaaatacttttagtagaagaagtattacttggaccatttttttttatcatcctttacccaatgtttcactggtggagaaaccgtttgtagtcccggttggtaaccccctcttagtcccggttgtccaactgggactataaatccgggactaaagatagctatctttagtccctagtgaaataaccgggattaaagatcgatcagctacatggccggccaaaccatctttagtcccggtttgtgttaccaaccgggagtaaagatcggtgcaccatttttttttcatggccctgtttgctgcatggctagttatatatatacatgtgtgtgtgtgtaaatcatatattacacacatatgtataatttaaagcacttaacattt

SEQ ID NO: 109394 - DNA, 662 bp, Oryza sativa
atcacatatgttttgattgaattagttaagtactagtcggaatcattactccatgttttcgattgcagtagtactggtcttaatgatcacattatgttttcgaggggccttagtactagtcgtaatcaactaatcatcacaatgtatcacgatgtaatcgtataggactctaattgctcacaatatctctgtaatcatcattagggtagcatatgcaacgaaaatcgcatcacaaatagtatataggtatatcgcagttttatcgtcatgaatcttgatgttgtgtaccagagggtcaattcaaaaaaaaaatgttgtgtactccgtacatgaatgaggtaagtagataagaccgccatagacacacacacagagtaggagtacagtacgacctaccggccggtagccggtagatggagggatcagttgtgtggaccaaacagtaactgcacactgtggcccggtagatgtagatcagtgtcgtacgtaataatgtacattggcaacttggcatcgccagttcgccggcccccaagtggtccatcggtagcatgcagcagcgcatgcaacgggtccatcgctttcgatcaatcgatcaatgagttgctgcacaatgagttcgctgcacgccatgctgctggtcgtggcggtggtacacatga

SEQ ID NO: 109395 - DNA, 727 bp, Oryza sativa
atgaataactctaaagttgttgaatttgagaatgtaaaaattatatgaatagatttgtcttgaaaaatactttcataaaagtatacatatattattttttaataaatatttttatagaaacaagaagtcaatgttatattttggagatcgtgtcgctgtccaaaacgacttcctttatgagtacggagggagtacaaaaaattaacgattcagataacttgtacttgtaataataccgacgtagaatatagaccaccacaaaggtaccctatctaacagaattgcggaaacattggtttatacacctatctacgagtcaattattagaaaaagaaaatgtgttatgatgctacacacatgaagatcgagatcaatcacaaatgcattgttagcgctagggtatggccacagaggtatggattcgcaagagatctgatctgagtggttggtacaagatatctcctgatcaggggcacctcttcatggcaaatgtcagatgacgatctccagctttccgtggggaattaaagctggctggctggctggctatggtgcatccatcgttgttggcttcttttcctcggcatccatctcattcaaggtatccatcgtcgtacgtacactgccttaagcccaatgctcaaccacaccttgcatatatcttctgcatattaattacctagctctagcaacaagctaggttaattcatgtgtagttgtggattaa

SEQ ID NO: 109396 - DNA, 679 bp, Oryza sativa
atgtttgggcatccgcaaaaccttatggtatcttagagtttgttagagataagagtcgtgtctgatatggacatattttgtaatctcgggtataaatagaccccgcaccccatgtaatcaaactaacacacgttcaatataatctcggcgcatcgccacccttttacttttgttttgtttcgacgagttcttactttcgggttgagctacatcggttccgatcttcaactagaggtaaaacttgttatggcggcttgcgttctcaggattagtacttccatctttatgatactctaatctcgtttatgtaattcgtcgagttatcatatatcttatataatttctggcaatatcactatctaacttctaatcggctaacgtctgttactagaaagcagccgattaggttaaatatcgacgttgacttaaattatataggatatctaccactctatgaaacatccaacggcttgattgtctagatattgtccttcttttcatacttatagctgcatcagttgagtttgatcttatgagtcatgattagaatctcaatctctagcctgtctttggttgccgattagggtagtatcggggtttcagccgatctcacctgatttaactacatttttcttatatgcttgattcacatgttaaatctgccatttatgttacgatc

SEQ ID NO: 109397 - DNA, 702 bp, Oryza sativa
tcaggtcagaccacagatcttcgtctacctcggcggctaccgcttcccccgaccaggtccccgactttgtcatcgccggcaactactacggcggcgcatgcactgtcttcgccggcaactcgaactccgacgccgacgccgccattgctcaggtgagctaattaacatctcaaaattcatcaagcagatcattggtgatcgattttattgggaaagcaatttcatccctcatccctcatcaaacaatatgaaaaattagcaacatagattgatatgaaatatatcactccacaaacatacaagtttgaattcaacttctacaagttaacaaaaataacaaatatagttgtgaatgtgcgataactattttcagtttaatttgttatttttgttgcaacttgtagaaattgaatttggtcttgcatttcttgtggactgatatattctgtattaatctatgcttttatttttttaatttttttataactatttagataacatgcaaacaatgagaggatgtcccctcgagggatgaaaatccatatccgattttattaacatttttgtttgttgaatttgatgctgtagatcactcgtccaaatttggcgggtacattggtgggattgacgaggtctgtgtatacggctaggatcaacccggggatagaccaggcgttcatcctgtcgctcgttgtgattctg

SEQ ID NO: 109398 - DNA, 690 bp, Oryza sativa
gcaagctgcctatacttactgttactgcaatatatgccaatacatgggtgcccatggccatctatgcatgatgcatcatcagatcaactacttggatggatcctgccctaataaaagtggctagtgtcaccacttggtaccacaactccaggcctcatttcatctttctccatccatgtaccatttttgatcccgtatcaagaacaaggtgacaaatgctagagacaagggcattggccatatgcatcaaatgaaaaatctggtacagttgctagctagagctagctagcatgcatgcaaagatatctgacactaaatcattctcatcaatgtaatccctgtgacctatcaccaacatgcatatatatacatacttgtatatataaactcttgtactgactgaatacatcagttgaatattttgcaaatttcggccaagtctacgtcaaattaactgctgcactatatagcagtatacatcgaacagtatgtggctatgtgctactgtgttatccaacatatctagtcaacatatatactagaagcgatgtgcgtccttcaattcatagaaaaaagaaaaaagaaacttccaacaagcagggaactgttcaaaagaaactgtactgtattatatactagtatttctgattctgaaagtctgaaacgcatttgtaaaaccagaaactgttt

SEQ ID NO: 109399 - DNA, 858 bp, Oryza sativa
aacgaatctggacataagacaggatgagacacatcctagaacaacgaatctggacatgaggcatgataaaacacatcctagaacaacgaatctggacatgaggcatgataaaacacatcctagaacaacgaatctggacatgacgatgtgtctcatcctatcctagattgctatattttgggacagatcgagtgtagatttttttcggatggagggatatttaataattactctctaaaaaaatcaacctagtataagattggaacaaatctagattatgtcttattctataataggttagatttttttaagtagggagggagtgcttctagtcctactcaaggtgattggtgttagggtttaccttcccgttttaagtgaaaatagctctcaccggtttacccaagacagagcaaattagtcgataaaaaccagcatcttattgttaaatccatatcaaaagttcaaaacccgctaaaactgtttagtttttacaaactgaccatcaacggtttcatgaaaaccgagcgacagttttcaacttctagtggattgtgatacaactgatccaactcggtaataaaatgtcaggttgaagattaaaaaaaaaaccagtgacagttttgttaaccctgatttatgcagcaaaacataaaagaataaagttaatgtgagaatgaaatgaatctataatcgcctgaatatactttgtgttcacaagaaaaggtagcagttaagtttcatgtttctcagcctttcgggctaaaaaaaaagtttcatgttttctgaatttcagatgcatcacatcagtgcaaaaagtttcagatcattaacgaatctgctgctccattatttaat

SEQ ID NO: 109400 - DNA, 1293 bp, Oryza sativa
caatctacagtttgaaccagtcaatggagtagaaaaggaattattttgctgaaaaaagagagatgtgtgcccctgggttaggggcggagaggagcacggggcaggccacatggaagacgtcgtcgcagccggcgatggccgccgccacgctaccgtagtcgagcaggtcggccttgaacagccgcagcctctccgcggcgacgtccagagacaccaagtgggcgttcttcgcgtcgtctttgcacaaatcatccgcactagcacaccaatcaatcaatccaccagaacaagagcataacgccatgaatatcaaaaactttgatgcatatggaggggattggggaagtgggcagcggcggctgcgactgcgagctctagtcccgggccccgtcagcgccacgctgaccgtgtcccgcggctgtgagctcgccgtcgccgcaactcgtgcagatcgatgcggtggcgccggaggagggggggcgatgtcgtgcagctccggccgccgctctctcgcctgccgccgcgcgctcgccggcctacccgttccgctcgttggcctccccacctactccctctctacgcacgctcgccggcctccccacccgatggctggcgcccttctccctctccgcacgcgctcgccggccggctagggagctcgaggaaggatgaagaatggccgggagggagaagggacaaggacgacggcgcgggggagatagagagcagggtgggtcccactatttttaatgactgacacgtgggtccgaccttttattttgcttccaagtgccacatcaccaccacatacgatgaggactaagtcaaactagccacatcagcgtcacatcagtcaaaaccgccatctaaaccgctgagggacctcatctacatcggttttgacagttgagagacccatggtatctggtattgtgattcagggacgaaaatcggactcggtgtaaagttaaggcacctcatatgaacttattccctcaatatatcctgtacaacccagcaagcacaataaaaagaagatgaaatttgatccaactttttttccgagtcaggtacgtacggcgcagattcaaagatttgaaaatagtacagtacgcatttgaaattaatcacgtgtcctttgaggagcgagtacacttaaatttctcgttctcgatctgttcagtagtcaactgtacgagttgcagtaattattaatctatcactgcggattagtggaaacgaccacttcgatctatagaaacagacttttgttttcgaggagcctgcattgat

SEQ ID NO: 109401 - DNA, 1266 bp, Oryza sativa
agtaatccaacctgattttctttcggggtgacatgcggccatcatatctctcatgttaaatgcatagacaagactatcttatctaaaaaaaagggatgagtccaatacaaccaatattattctcaaaccaaacatgatgttaaacttcttgatttggactgttaatttacctgataatccctccatcccataaaaaacaaatctaggaccggatatgacatattatagtccaacagatttattgtactatagtatgtcacatccggtcctagattcgttttttatgggacggagggagtagagtagtatacatgtagtagtgttaggagtagtattagggtgtgtttagttctttgggtgtaaagtttttgaagtatacggacatacatttgaagtattaaatgcccagtaataacaaaacgaattacatattccgctcgtaaactgcgagacaatatttattaagcctaattaatctatcattagcaaatgtttactctagtatcacactgtcaaatcatggcgtaattaggctcaaaagattcgtctcgcaatttacatgtaaactgtgcaattgatttttttccccacatttaatgccccatgcatgtgtcaaacatttgatgtgatgtttttggccaattttttttatctaaacaaggccttaagctgtgtttagttcccttcaaactttcaacttttccgtcacatcaaatgtttggacacatgcatggagcattaaatgtgaaaaaaaaaccaattgcacaatttacatgtaaattacgagacgaatcttttgagcctaattacaccatgatttgacaatgtagtgctacagtaaacatttgccaatgatggattaattaggcttaatagatttgtctcacaatttacaagcgaaatttgtaatttgttttgttattagtctacgtttaatactttaaatgtatatccgtatactttaaaaactttacacccaaataactaaatttagtggcatgtgcaatgaatcagtcgtgcatgcactagaaactcgcaagttgaggccctaggaatcagtaaacctgacgagtttggccgctccaggagaggcatccatccatccatcagacttggcaacacgtagccggagctagctagcccaagtctatttcgtcgttgcatttgatcgtgtgtgtggccggagcccggagtagtacactgttcaagtcgaggagtagtgtgtgggagagagtagtctaggagtagctagctataggaagcgag

SEQ ID NO: 109402 - DNA, 1098 bp, Oryza sativa
gccactaattctagttaaaagttacatctaacctcacttccgatatactcctacacattaatcccaactcctcccccacctccacccaaccactttcacatctcacgtgagcaatgtactccctctgtcccataaaaacctaacatagtatgggatgggacacacgttaatactgggaatgtgaacagatgggtttaaaattatagtattagaatgtattatatatatctggtactaggtttgttttttataagactaagggattacctagtttgttttgcatgtatgaatgcgcctcctccctcaacgtccgcacgcgagattgctggcgaccgccatggctatcgttgccacaacaaaaatggtcatggcgctatcccatctttttatgcttccgtatcactctaaggagatttctctatgtcactatttttcttgacgtctcccatcacctaaccatttacccaaatgccctcacgtcccttcatctcaaccctctccccatcttcctcaccctgcatttaggttactggagccagaggggatgattgtggagcatgaatcgtgaagcaaagtcgaaggcaacaaaaccataaggatttgatcattttttgaatattttcagtcgcatgatattagcaaatccaaaaaaattattgtgttaatgtaccagtcgaaagtaaaacacgatctaccgaactgacagcaggcttgaaaaagggagcattgctaaggtccagtgagttatggagccattacagtgagggaagtactgatcatctctccaagaatgacctaaaacacgcatctgactccactagtctttgcaggttatcgtcatcaaccacagtgtgacaatatcctttaacttcatctctcatcagagtcaatatattgttcaaaactttatcagcctagcttatcatgtgtggtatgaccaagtactaattttttataggatatttgtctagtcaatgactgatgaatagtggaatatatactcttataaaagaaaataatagtggtaacatataatcttataaaatatagcaatagtggtgacagtaaatttgtcacccgtaaactctattttataat

SEQ ID NO: 109403 - DNA, 553 bp, Oryza sativa
tcattcatgaatagcactagtacttggttcgtggccacacgtccatatatattctactccctccattttataatataagtcattctagcattgtttatatttatatagatgttaataaatctagatataaacatatatatcgatttattaatatctgtatgtatatggacaatgctagaatgacttatattatgaggaaatactgtttttaaacaagtgtttggttctctgttactcatgttagagcatgttagcgtaccacatatactatttttagcgtgctccatgtgtgccaatagtcccggtttttcaagtcaattttgctgtcgaagttgtggtgccgtgcaccaatggaaagaaggatttgcagccaaatgtgtcattaccttagtattatccattcaactgcactatgactatcactcaataaaataatagttaatttgcaaggtcggagataaacttcaccagtgcaatagcaaacggtgagtggttttaatcctgagatttatgttcaatccctaacacccttacaatttctttttaaaaaagt

SEQ ID NO: 109404 - DNA, 996 bp, Oryza sativa
gagaaaattagcaccttgtgcccttcttccttaagtttttcctgccatgttttctatgtattatgcatgcaagattatcaatggataagcatacattgctctaaagaaaagcattgagtgcagaccaacaattgcagtataaatgtaagcttgcatgacttgagacaatttgatgtctttgtggtattctttgcaatcaaagcttcaagttttttgacaatgccctgtaacgtcctgttttctttcaacgctaattgttcctcacaggaatctacagctgtcaagttctgaggatggttgcatatcttttggagcagctgtttaaatgtaaacatgaaatatctcaatattatgaaaaaagatacaatccatctctaaggaaattactcgactagtgctacagaccatcaaggaccataagatcatgagagagcaccatacataacttaaaaaaggacgattaaagagaaatttcagaagtaccattgttgcaacaaatgttgatcccttcactgtcttatcaatcaaattgctcttcataatgtttcatataattatatctgcgtacacaagaaaagaggaataaataatgctaatacctgaatgtagctttttcatcaacgtaatttctacctgatatggcgttagcttcagccagatgacaagatcagctttattaggtaaaaggctttcaatactttccttggtgcgcctaagaaaataaggtcgcaccattttgcggaactcctgcaagcaacaaataataactgtatagaacaaataatacaagatgttttcggaaacaaaagcaaacgatgaaataggaaaatcccatggcctttttagaagatatcattactacttcagttgttgcctaaagcccatttcccatgtcaattggtttacaaaagtctctttcaaaagcacaagagagcccaagacagtaggacagcaaagactcattagtgaatgaaattcctgcctgtgacattttcc

SEQ ID NO: 109405 - DNA, 834 bp, Oryza sativa
ccaccaccacccacacatcaactttctttccacaccacccaaaccaaaatgaggagtagtttggacgcttacctcgagacgtcgtcgcgagagtagtagcggaagaaggagcatcgcggaaggaggtgggtgttatactttgcactaggatcacctaggttagatctagtcgggtggttctatttgggattgaggtttgaactatagagattgaaaacgggagagggtttagatagaccgaccggttgaggtgttggaggatgaagaagtgccggccatcgtctccgttggcgctcggttgtcgtggatgcggcgccggtgaggtcgacgacgatgacggctgcgggagtgacggttgtagatgtcccggcgatgaggtgtggcgcggcggtggcgcttcccgtcactggctgcgccccctcttgatcggattagggtttgtagggtggagttggcggcggcggtgaatctcgaaccttgtgccgtgccggcctccacccctcttttattatggcgcagtgtgacgggggcccaccagccattgggctgggcgcccccgatcagggcgcggtcaaggcccccttgagccgttgggctcaaggggagagagatctatctaacattctcccccttgatctcactttttcttttagctttttctattccatcacagatttgtaaatagagcatgtttcatcgtcacggtcaatcaccgatggattcgacagccactatacacatctctattcagaaacagatactttacttttgggccctgtagtccaggattcataaggcttcccttaaacccatgccggctacatgttcctttga

SEQ ID NO: 109406 - DNA, 566 bp, Oryza sativa
ctatgcagggatactgtttccgctcggctatctaatccgctaggtctatacccattcaagaagtacggttgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctctacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcatgatcacaagtaggatgttcatcatcgcatgcaattttatttgtaaacaaaacaatttcgcaattgggatcaacatgttcaaggaatattgatgacttgccttgctcaatgtcttgcgggccttgaccttcgcttg

SEQ ID NO: 109407 - DNA, 1396 bp, Oryza sativa
gaatgcgaaagtcgatttctttatattaactttattattcgcgaactaaggcaaacccaatttcgattcaaactattttgcgggtataaatattttgttgtcataaatttttaatttaatctacccgagcattatatccatataataggttagaaatttctatcgcgagctaaatatcggacggaatcctagaaatattatacgatttagtttagtctatgactaaatgattaaatataatacacgggtaaaatccctagtagttaaacccaaatttctaccgtgaatcgattacttatagggattacccataaataatctataataatccataagaattcatctatttgtttagttattaactacatctaaattattaccgcgaattgatttcttatagaaattgccaagaataatccataatttatattaaaattttcaattctacgactataattaatctataattaaattccaattattttaaattttctaaacttccctaatctccctctaatttcctatttatttcctttttctttttctccctttctttttcttttcttttttctcccggctccttcctcctttcctctctttctttttctctctcttctctcctcccggctcctttctttcttttccttctcttcctctattctctttcggctccttctccctccctctctcgtcctgcctaccgagaccggctgaggaaaaggaaaaaaggcggcggcggcacggcttactggcggcaacggcaatggcggcagcgcacggtggctgcgacagcggcggtgcacggcggcggggaacgtggcacggccaaggcgcggcgtggcgcggcggcttcttggcggcggcgcggcggctctatgcgacgactccggcggcgtggaggcggcggcgtggtggagtgggtagaggagaggaggtgaggatggagggaaagagtgggaatagtggggtttatataggagaggggaagagataagggggagaggggagaggggagacgcgacggcggcgtggggcgcgaggtgggggcgcgcggcgcgaggcgacgcgacggcggcgtggcgcgagcgacgcgatgggcgagcggcagcggcggcgcgcggcgcagcgcggggcgcatggcgacgcgacagcgacggcgacgcgcgagtgatgcgacggcgcgcggcgatgtgacggcgatgacgacggcgcgcggcgcggcaggcggcagcggcgcggcgcggggcgcgaggcgcggcaggcggtaacggcgcggcacggggcgcgagacgacgggacggcgcggcaggcgtatggcgcggcggggcgcggggcgcgagatggcgacggtgacggcaaaggggaggcggagcggcgcgcggcgcgcggggacggg

SEQ ID NO: 109408 - DNA, 3576 bp, Oryza sativa
aatttacttgaacttaattagagttaattctcattccattgcttttaaatttgatggatataaatatggtcgtaataatattttactcatttctatccttaccaaatcttattttaaattgcactttaattatttactttgtccatttactttttagggtttattcctaaccaattatccattattcgcgatttataaactccgaacccaaactccaataaaataatcgaataaaatccgcatgatgcaatttattaaaaaaagtttttgaaaatccgcatttttagagttttgatttttgtcggtcgaattttcagggtgttacacaagatgggccacctgagccttcgggctggcacggccctgcacgaagtgccccgatcgctggtgggccgtgcctagcagtgcctgggctgggccgtaccgggcgggtcttatggccatctatagtctccattgttttagcacgtgctaatacttaatatggcatattcatggccactgatatgtatatatgtcatagtatatactcggtgctgctataattatatcaacacattttcttggtaatcacagtcgattttcagttcaattgatctcgcttgagattcgtgctatgattgaaataccagtgcactgaatgtcgtctttgcgtgttgcgtgtgcagcgtgaagccaaaaaatattaaatttaaatttacaatgtaaatactccctccgtcccaaaaaaaggcaaaccgtgggttttcgtgccaatatttgactgtccgtcttatatgaaaattttttataattagtatttttattgttgttagatgataaaacatgattaatgttttatgcgtgacttatctttttaatttttttcataattttttcaaataagacggacggtcaaatgttggacacgaaaatcagggtttgtcttttttggacagagcgagtacatactaactatttattgtgaaaaatatgacatcataaatatagctactctcgttcttttaacataaagttagagggacgtaggtcagtgatatacgaggcccattcacatgttagagcgacacgtcccttctatatatacgtgagatgcgtatcatcgtgtgtgtaactattctttcttacattacatgtaatcgaaaatattacatgtattttaaaactgtattaatattacaaggacatgttttctaaacctaaaggatatatgagcgcggaatatatatttattaaataatataagtatactcagaccgacagaacataaccctatccgtatcattctccagccaagctttaaacccttctccatttccagtttcctcatggtctactcgtcgtgcggtacaccattctattttctatccccttgcgcctagcgaccagccattagttcaaagacattttgcttgtatctgctcttcctctcccgcgaaaatcaagcaccgaggtgagcgccctccactacatcgctgcggagaagagaagggcgtcgtgagtggcaggtttcgcctccaggtactgtacgtattattttctacttctattcttctatcatggtgtacgtttgcgcctccagttttcttccaaatagtgggagatcggtatgctttcgtgcatgtcctggccttccttggacagagacacagagtattgccgtaagccgcggatgtatcatctcttcgatttgatcgatttgccgccccggcctttgttttgtcgctgcttgttctgaggagatgatgtgtcttccatgaagatgaatggggcaacaacaggacgtgcctgccatattcgtaggatcatcagatcatcctaatgtaaactagcactctgtttttctcttttcatcatctatctctctcctgacagaaaatatcatgtgctaagagttctttgccatgacagtgtaaattttacacaagtatacaaagccgaacatgcagagaatttcgcttgttgaaaatgcaaaaggttgattacacgtatgcttttcttttcgaagtatcaacaatttcagattctgatgtaggaaggcgaagactatttgtgtatatagaaaaatgaagaatgcttgttacataaccaagcttcaacaccatgcccagtctacaaaaatagaaaggaatatcaaggcgatgcgatattaactatacttaatcaaattaactgctccagctcattgatagtgaaatttgaagaccatgttcaatgctcattcctctctgaccttactcataccatctattccttttcaaaaatataaatctcgaccaagtctttggcatcgatctacgtgcattgtcagtgcaaaaaatatatattaagaaggtaatggaagtgaaatactgaaatatcaatataattccatctaaaaacaggaggagataatggccagtgagcacaatactccctatggtcataaatatttgaaatttagaataagattacatcaaatgtcaaatgcttatgaccagggggagtaatatttagtttgaagtatgaaaatgagacataaatttatgctgctaataaactactatagaatattggtttgttagaactgtgatattttgatgaaaaatgtgcattggaatttgcattttagaggtgtctcaattgaccggtgtgatactccctccatttttcaaatatttgtccgtgttaattattattgtttgaacttttattatggtcaatttttgaatggatagattatgatgaatatggttaaatttaggatgcaatccactttgataatgtaagtatatatttaagttatatactccatccatttcatattaaaagatgatttgactatttccccaattaaacttctttaagtttgatcaaatatatagaaaaaaatagcaacatatacaactccaaattagcttcatttaatctagcattgaatatattttgatggtatgtttttttttgttaaaaatattgccatgtttttctataaattggatcaaatttaataagtttgattaagaagacaaaatcaaagcataaatatgaaacgatatttagaaaataagaatgaacaaattttaaatacgaaagtatctagtgatgtttatttggactttgcaaacagatgaagcagtaccggtttgtggcatgcattatgattgtttcctcctgggcgtccttatcttagaaagaaattaaaccattaattttggtctcatcctgttacattacacgctctggcttattcttggttgcagacaagctatagctctgcgcccatcggtcattgcccgtggagcctatactatatcgcgacattccgcactctcggccgtgcacaaggtgtcgatggcgtcggcgcggccgtaccggttccccgttccggcggagggcggcgagccgaccggacgccgctccgccgccagtcgtgcgggacgtgcggcgcgtcggcggtggcgagctgcgtggcgctgtgctgctgcccgtgcgccgtggtgggctgcctcacgctggccctcgtcaccccgccctacgcggcgggccggcggtgcgtggccaggctcgccgccggcaagcggcggcggatgatca

SEQ ID NO: 109409 - DNA, 525 bp, Oryza sativa
ctgaccaatttagtccacatcgttctcttcctcctttgattttgatcttggatagccactactgggtgcatctttctcctgctcgcgctctctgtgccctgttcatcaccgtgttctcgttttgtgttagtggtgtgtggagtctttgattgctgtgtgtttttaagtttctgcaggatgtctatgttcttgtgggtaagtggggtatgttcaacttggctctttagccatctttgtacatcttcacctgcctggatttctagtatcaactgatgttcttgtaatttctatattgatcattttcagaacgacccttgattgctggcaagtgggtatgggcactgttctcttttctttgatctgtcatccgttctgtaaattgtgtttggagtttgttatctgttgtggtacatatttttttctactcttttggacacggtttttgtttaagatccctactatggctgttgtggtacagattttttctactcttttggacatgttttttctactatggctttttga

SEQ ID NO: 109410 - DNA, 748 bp, Oryza sativa
atgtaggctattgatcaataatagctagttaaaatagtactgatatgtactatagcaatagaactgttgttcaattaactggaaaatagctaaagaaaatgagaatttctaacactttaaaaaggtttggaactgcaaacagctacactgttcaatgcaaggggaaaattatggactagaagaacaaataatgctgtttaaggaaacttgaaaaataataagaaaattgaatgggcataatacagctggcatattctacaaagccatagagagcccatcgaaacaaaaggaaagaagtcttctgtgttatgcatcactaaaatatttattcatcatattttgataggtatgtgttctagtggcactgatgaccttaagttagctaaaaaaattgatagggggcatttgggaaatgtatatcagaaaatgaaaagaaacaaaaggaagtatttgcaaactaaaattaactcactaaaacatctattttggccatgattgtctgaggtaatagttacattgttcacaattacagtcacctgttgatcagaaaatgggagagagagagagagaagtatttgcaaactaaaattaactcactgaaacatctattttagcctgcttgtctgtacggttgttcacaattacagtcacttgttaaccatatctttttaactttaatctttgctgtttagaatatgtaaaatggtcatatgaagccattttattatgcaatttacatcatacactg

SEQ ID NO: 109411 - DNA, 1051 bp, Oryza sativa
ggagtttgtagttgaagtggggagagtctggaggcggcggtgtcaccagtgaagctccggatgggttgggtgggtggggaaagtggaggggttgtgagggtgtaacatcctgaaaattcccaataataaaaatcactaaaattttgaactttttaaaactttttgcatcatgctggatgttatggttgcttttacttgccaagctataaattgtcacaatggaaaattaaactaaagttatacagctaagtaataattataataataagatatttattatgaaccccataaatatttactcacgagaaaacaaagcgagacaaagggaaggttaattaccaatttaatttatgtatcaaatattaaatacttgaaccatgtgatgcgtgccatgaaatataaacacttatgataatcattcaaataaatggaactctaactatagagtagttttactgggaaaaattaattagatattatataatttgaattgaatcacaaatgctaaattatagaaatctatgtggtggtaaaaccaatccaaaaagataaaccaatgtatgtgaaaacatataaataccaaaatcccaaatatagggaaatataaaaaaaatctaggatatatattaaatattggacaatattaaaattttgggaaaattcacatttgagcacttaatacggtcacccaaatgcttaggaataaaccctaaaaagtaaattgactaagtaaataactaaagtgcaacttaaaataatatttggtgaggatagaaatgagtaaaatattattacgattatatttgcattaattaaatttaaaagtgtcggaacaggaattaaccctaataaaagaattcaaataaattataaaaaaataaaatatgaataaattttaatttaaattgagtttattagttgagataacacaattattgaataaaatgcataggtgcaaaaattaggatttttggaatcaaaatttatatgggaaaataccctaaaatcggttttattagaaaatggcactattcattgcccgccaaagtgt

SEQ ID NO: 109412 - DNA, 741 bp, Oryza sativa
atgtggacccccgtttttataacaggaatcattcgtgtaatcagtaccatttccctggatcaagtagtttggtacacacgaactcatagctgaaatatcaagtgcacatacacgaaagtctagtacgaattattacatcataagcccgcaggcacagtcttaaatcatcggaccgagcggtccgaaatacttccaaaagcagaaatagataaggcagcggaattcaggcagcggcatgccattgccacaggcaacgaccgtactaagacctactgagcgccatcgtcttcatctccctcctggtagtaggcatagggatcctccgaagcttcatctcccgcctctgattaattttatagttgcaagggtgagtaccaaccgtactcagcaggccaccacagcaatgatgcacatgacagaggaattcaaaggatgactatagttcttttgcgtaaagccagttttataattcttttcacaagcctaagacctagcatagactgatcaagttttaatatcagtgttcatattaaacaatgacggttctgtccaccatccattgtgatcccaaggatagcttcccgccattaagtcgtcatggttttctgaggacgtccacattcccgcctctcaggaagtggctccatcagcataaaaatcatcatgcaatatcccatcccacacaagttaaagaatttagagtctagccaagtgtaacacatgtcccggtgctcaataacc

SEQ ID NO: 109413 - DNA, 577 bp, Oryza sativa
ggtccaccgccggtccacgggaccgacggtccggatcggcctcaaagacgatcggacggcgcggggaaggcggctaggcacggctcggcttcaaagccgaccggcagccatggcggccgatggcgacacgcgcggtcaccggcggtgaccggcggcggcgcgcgagagccggcaacggcaagcgacggcgcaggaggcggcggcggccgacgcacaggccggggggggcgcaagaaggcgatggcgagcgcagggagcggcagcgcgtgcgggacagagggaaggagggaggagaggagctcctcacagtgagcacggcggccggcgcgaagaatgaacacggcggcgatgaccggcgatgcggaggcacggacgggcggcggcgacaccctaggagaagatggagaggcgttaggagaggagccgacgaccacggggcctttaattgctgcccggagatgaggggagggaaaaactcaccggctcgcgaggggagaggccctccggggggattccggcgacgcgaggcggcggccgggaaagctcttgcggcggcgaagctaacggcggcggcggt

SEQ ID NO: 109414 - DNA, 537 bp, Oryza sativa
atgagggtttcttcgtcttcttatataattagcgctttcttccgctgcgtggcgcgtcgagtggtaacgatctatgatctaatacttgcatagttcatggtttatacgctagaaaattttgatttatgctatcgtagcgtgcgcgtatcccaacatcttcctctgctcgacatcatttgctactgttgcatcctcgctaccgtgcaagagttgcccttgccgagtgggagagagaggaggaaggaggaagaagatgactagagagaggagatggtatccatattagcatcacgtaaaatcccagatgggttgtggcaatgttgggccagaatgacactttaatagattgacttagatgcgcattttaaaagtacgggaaactataaacaaatctagggaccagccatacactttagattagtagatatatagttgaaaacgatgtgcattggagcaatggtggacgcaaggctcattaaggcctggtttagttcccaaatttttttctcaaagacatcatatcgaatctttggacac

SEQ ID NO: 109415 - DNA, 761 bp, Oryza sativa
aacatgtgtagtagcttacttagggctgctaaacgctactccgtaattgggtagttataaaagtagttttcgagtatgctatgaaacatgtagtgtgatatgaataatcaatatgggatttcccccttctatggagagatatctctgggcccctcgatgttatagattatgaaagtgcatggccatgccaaaggtgattgaggagtctatcacaacttatataatctatcacatgttcgagtgaatgattgagatattagaggatggcacatatctagccttgagcttaatcgatatcgcgaggcaaaggggtttatacaagtatacactagaggctcagccgatatgatctttgtctatgcccgatgggtcaatacgttctgctagagaccactattgacacgtggaccgaaaaggagttttcgggttacaaccgagtgtatatgaacctactgggtcgcacgcttaatgggccagaataaggggatggatggagatccaatatgagtttaattcggatagggatctgaataggagtcctacgggccttggaggcccgagtcatggatcatatatattcatgagggatgtgaccggtagatgtattgcatcacgtgagaaaccctagccgccactcccctccccgagcaaaaccctagccgcgcgcgggtgctagcacatctgcgcatgtcgttccgtctctgtacgtgtggataccggtagagacgccactgctttgtggtgctgatcggcgtgagagt

SEQ ID NO: 109416 - DNA, 694 bp, Oryza sativa
tccaccagtgtatcgcccagtcctaagctaagtacgtctccgttttatctgccgtgcgtagtgtatttttttcttttagcgtcggtgttccaccgtgttagcttgaagccacgcgaggcgtgagtgacacgagacccagagcagctgaccggctgcctcgtctaccacattaatctggacactggattataagtaagatattgagtcgatactgaattactggtggtcaactgtttaattgcacacatacatgatcaattgaatataactatcatctatctattatattattaaaagaataaaaaaatgagcctccacgttcgctctcatggcctagaaattctcacgttaatcggagaaaaagaaaaagcagagtctatatagaaatacaatttagaaatagctgaaattcggaattaaaaaataaggaatattagaagaggagactagagtccatatagaaatacaatttagaaatagtttaaattcggaattaaaaaataaggaatattagaagaggagactagagtccatatagaaatacaattaggaaataactgaaattcagaattaaaaataaggaatattagaagtagagtatagagtccatgcagaaatacaattaggaaataactgaaattcggaattaaaaataaggaatattagaagtagagtatagagtccatatagaaat

SEQ ID NO: 109417 - DNA, 726 bp, Oryza sativa
aaccggtgcaatttgactcttaagacggttttgaagggcggttttgctgacgtggcggtattgaccgggtcttctttatacgtggcgttgacgtggcgcttaagtggcattagaattaaaataaactagttgataccccgcgcgttgcggcgggatatttgtattgaaatagaatttaaaaatccaagtacactttgtgagataaaaaaaaataagcaaagaagggaaactgacgcaataccaactgcagtctgaaattctggatgatagtggagcaacttttgcaaggaataatctgatagcaatgcttcactttgagtgcattgagaccccctcatgtaaaacaccacaatagtgcctgacagaaaataggagtatattgatcaaacgctagcttccaaatctatgggggcaagaagaacaatactgaaaatactcaatgcagtccttgtcttacatatatatatatagacacacacacacacactacagatggaagtttgaagatcatcatcatatctaaaaaaacaggattcacctaagatacaaagacatgatgctacctcagaagaggaaatatgattcatgaaagatacaaaagacatgatgctacctcagaagaggaaatataattcatgaaaagttgataaattatgcagtttctcagtacatgaggaagataaacatgttatatgaatcaatgtaagtttgaggtaaaataaactg

SEQ ID NO: 109418 - DNA, 626 bp, Oryza sativa
aaaaaaggtctatgtttggatgtaaaaaaaggttaggaagcggtaacacgcaaggataatactcaccttagttggatttttcgctacctgtctcttggcggccagtccacatatatcacaccatatactttagttttcaatgccacattttatatatttaaatatacttaaaaaatgcccgtgcgttgcatcgggtgaagtcttgttaagatggaattcattgtgggggttcgcttggatatatatatatatatatatatatatatatatatatatatatatatatatatatatatatatatatacatatacacatacatatacatatacatacatatatacatatatatatatacatatacacatacatatacatatacacatacacatatagatatatatatatatatatacatatatacatatacatatacatatacacatatacatatacatatatacatatacacatatacatatacatatatacatatacatatatacgtatatgtatatgtgtatatctatgtatatgtgtatatgtatatgtgtatatctatgtatatgtgtatatgtatatgtgtatatgtatatgtgtgtatatatatatatatatatatatatat

SEQ ID NO: 109419 - DNA, 1987 bp, Oryza sativa
tttattacctcgacaaactagacgaaagacgttgcgacgaagaagaaacctacccccaagatgccatcaagagtaaggatatcaaagagagtgagggcaggtgctccaaccgaaatgcctcctggaatctcaacaagcaaatcttgcaaatgaagcactggcaaagactcaaaaggagttagcagagttcaagcagcagcaggaagagaacaatttccctttcgacatatcttgagcctttcccagggtaacttaaatatgtcctagtctcctttatgatcttatgcactgtgatgaactccatgtacttatatctgttttgatggttctgggcacttattgtcatgtggtggacttggttatgtgaaatgatgtttagtgctatggtggacttaattaccatcttgtagtaaactttgtggacttaatgtgaacatatgtgtgctagatgaacttatttgtaatatggtgctatgtgaagttggtatctgtgatatatgtgatgttggacctatttgtaatgtgctgtgaagttctgattgtttctccatgtgatcaatcttgatgttgggcctatttctatgtgctacgaagttctgattgttttttgaaatgggtcaatgctaaaaattttgtagacctcatagtgggctgggccacaactatatgtaaagtgtgtgaccaaatgggctggccaagaaaaatgagtgggccttcatccctactgtgtttgaaacgtgtcatccaaacaaatcaacacgtggcaacatcatgtaaagacatgtgtcacaaatcagatccgtacacgtggcacttcaaaacgagagcacgcggtgccccaccttcggccacgtggcgtcagcgtgcaccaccacgtggacatacgaaatgttaacacgtggcactaaatatgaccgccacgtggcgttaaatatgactgccacgtggcattacatatgactgccacttggctctagcgtactggagatgataatccagcgtggcgtacatgtcatccgccacgtcacagccaacgtggactccacgtgtcaaagccacgtggcttggactacgtctgtcagtggccagctggaaagcatttctgtgacgagcaccttcgtcatggatagaagcatttctatgacgaaatctactgtttcgtcgtagagaaacatatgtgacgcgacttctatgacgaatcatatttcgtcataagttcgtcatagaagttactttatgacgatttgcgcgtcttccatgacaaaagtagattgtcatagatgtgcctatctccactagtggatgcagcctcgaacaacaccaacgtagccgacagattcactagggccggcggaacgtaggacttaccccttcgccggagatcgaaagtcgatgcagccccgcgtaaggttccaaattccgccggttgataagtaaaaacctcaggaaagagggtggcgatgcgccgagagtagttgtattgatcgagattgatagattacatagaccctgggtgtacatatttatacccatgggttgataagtccttgtcggacaagaaagaaactatcctaaagataaaaggaaaacataaagtccttatcggacactaaacacactttcctaaagataaaagaaaactaacaaactattactaattaatagataaactgccatgccgcatccttcttgaactcggactcttctggataaattccctttaattgatccaattccatcgagaacatggttgctggcgatttgacaactcccatcggctgattccaggactctaaagccgatattgactctaagacgatgatgactttgggcttaccaaatttcactgttaacatgaccataactggtcgcgtctgggaaaataggacccattttcgcgtgcggaccatttaagagaacctcacggaaaaatggaccgcacgcgaaaatgagcctattttcacgtgtggacatattaaaagagccg

SEQ ID NO: 109420 - DNA, 548 bp, Oryza sativa
tgggaggttagctgaggttgcagtgtgtttcttatcgattattatttgatctagacgagctgacaagatagactttccacttcaaatcgctctcattacgtttctagaatttttttttgtgtggcaacaaacaaaataacataatattattccggacgttatgaaaggacatgtatggaccaaagtatgctttcttaacgatgacgtcagcatacacctcggacactgaggtcttagtttcacatcacaaaatgaaagtttctctataaattgttctggtccaaactaagaaagcaattaatagctactcaatccaatctaatctcgaaacaatttcgataatatcgatgccatcattttgcttctagatcaaacaaaaaacattttttttacccatttcttttgtggcatggcatacacgttcagcacaacattaaaaaaaaactcactctctgtctattttaaaaaacaatttcaggccatgaagaaaacaaattctcttttccaatcagttgaccttgccaggataaaaaggcaggtgcagtggc

SEQ ID NO: 109421 - DNA, 853 bp, Oryza sativa
acatatttatcagttgcaaaggtagttatactatgcggactaagtggtgacatacacttgtttcatttatctactgtaccattagttttgtaaccaaatttgtctctctaacacgttgtagagacgacaaattaatacagataagactggtctagctcattcaaggttgattctctccttatgctccagttagatgatcatgagatcaattcgtctgtcagctcataggcaattcatgtatgattcttccaaaataattacataactcctttgttaataatggacactttttcttgatgtgatttttttccatacgcatgagtacgcttggtccttttattatcgctataaaataatttaaaactctaacatattactgttacattatcagtaaggagtaggatcctacaggggttcagtatttctgaattaaaaaatattttgcatcatcgatatgccattccgtcgaaaaaaaaaaccaaacttgccatgctccccatctggttgttcaagtgatatcctatctgcagatcactctggacatttttttagttgattgacttttgtggttcagttttgctttgacttcttttcatttatagaccgtatggtttaccatgtaattatcataagtgcggtatataatcctttccaaaaggtccatggttgaatggaaaataaagcccctaatataaatgtcaacccaaccatacgttgatcggtcaccctcgtcgaatagacagcacttctataaggaaccacccatgttaggataagaaaaattattcggttcagatcatcatttggatgtaacttaatttggaagcgcatcatgtatgtacaacgtcaaatc

SEQ ID NO: 109422 - DNA, 875 bp, Oryza sativa
aatgtatgatgccctcctgcatttttaccatgtagcagtatatctataaagactatagtgcatgcagatgttattcggtttacagtcatgggcactatatttctagcactaggatattgatgaacttcttttacaacagagcaaatctttcgatcattggtacagcatcattttggtatttaaacatgttactgaagttagtgcatttggcttcattagctgctgccaaatatctcggtctacaaacacattctctataattgttcagttaaaagtaaatttatttgataggacagggatgaccaaacaagtcatgttgtttccctccccaaacaaataaatttttaaccttttgttaccaattgaacatttcttttcttaccttttttttttgcatgatgaacacttttgaacattggttttttgttaattttccagaaatatcaccactggagctccagaagtcatggttaattttgtcacatcatgttataagcagagctattggagcctcttgttaacaatatcacaaaaataccagaagtggtatgtaattggtgccttctcattttaagtgtactatgtcgaacagtgtaatgtttaaaatacttttcatgtactgactattatgtcactcagagttctactgtacagaaatcgtgggttgtaagccaaataaataattaattacttcttcctacaatattgatatgcctgtagtgttgatgtaggtcagtatcatgaataatgtgaatacgtctgttggcaatacatctgtgggggaagaagaatataccttgtatgagcaacctcccattacagagatgttgagaggactacattccagatatctgccaactccttttccagactca

SEQ ID NO: 109423 - DNA, 825 bp, Oryza sativa
aaactatcgtaaaacttctagatttctcactatcgatcatgggagagtgatgttactaaatttatcactaaataaactattgtaatatgctacaccgtttattaaaaataattctctccctcccttcccatacgcatgcacgccagcgacgacaaccgaacgggagaggtgggcagaggcggagagggtggacgagggtgtggtggcggcttgtcaaccaccatggcgtcgcagccacgctcgtcaccttcgtcgacatcaaacgcccatgtcgcacactctgctgcggtgtcctcgttgtctcatcctgcgtcgccaccgccatgctgctagcggtttccctcgatgaccacctcactgatgccgccatggagacggtctacactccctcctgcaccttcgtgtgctgctccggagctattgtttgtgcacaccttcggcgccgacctttccctttgcttcttccccgtgacggttggttggtctgcaatggcgttgtcgtagcgattcttggacggccacaatagccacgtcctacttgcagtagctcaccatcgccgacacgttggctcgtatcctgaggcgatgtcgctgctcggatttgacatcgtggagaaaggggaggacgacggcagtggccgctctacctgctcaccatgtgctgcttatgtgtcaaggtgtgggctggagcggaccgtcctcgcggctgtgcaaatccggcagctcagcgaaggatccatgctgcggcggagaaggaagagaccgggagattggccgctgctcctttcccgtgggccaccgcacgtcgctcctcttccacaggtc

SEQ ID NO: 109424 - DNA, 510 bp, Oryza sativa
aattgcataaacacaaagtagggattttgttttgctcctgttaattgctgtatctatttcagtgacttataaaaataattaaagcaagctgtgcaattcaattaagtcatgacaaagtatgacaccaatgtttatctccacatcaaattgctatatcttcagcaagaactttcacagaacttatcaaagaatggatatttcacaaacatttaatgtacaaaagataagggcctctaccatcttaaaaagatacatttttcacatcatggtgtaactttcattataatgtaagtgattctcaaatagttatgtttagggtaacacagtgaaactgccatatgaagataataaaatactaaaccaccaaagccctcaagcccaccaaaaatgcagaagtaatttccatgcagatcaacaatgcagatttgatcactatttgaggggtggtagatataagaatgcaagccctgtggagccctgttcccccaaaacaaaaacacttcatgtggc

SEQ ID NO: 109425 - DNA, 1540 bp, Oryza sativa
caaaacaaggaatcaccaaaatatcaaatcaaataatcagcaggcaatctatctgtattgctatgagacgttcaaactaacaaaatccattcaagggttttgaggttgattataaaagaaagaatttacaaactataatgtgacttaagtttaagaattaaaaaggaagtaaaactggacattagtccggatcaatgatatgttttggccgtgtcataggtaacagtcatagataagtcaggattttgcaaaccatgtccagaaggatacatacattgtaagaggccattccattgaaccgtgaggattctcagtgcaattcctttcgatggccatgcagccaggtccatcaatagggatgaaaacaggagcagaactgaggcacatttggcagatgtgaaaatgcattctagaaattttaaatcaggaatttgttttcttgttcagaaaatcatgcgtacagggccctagcaatgccatagttgcagcaaataatgaaccaaaaagttgcccgagcgtagcaccggccccaataaaaccaaacaatcttgaacctgatgaattaaaagagtaataagaatatcagaagcaaaagtaatcagttgtaggtaatttgccaataagttttagagcagctgtaaatgatacccactatccatgatatcaattactcttgcccatgttgatgatattgcaatgagattaagcaagggaaccttcaaatagacataattactcaaatcaataatcagtttgggaattagaataaatgaacatgcccatgtagcatgaaaagtcgtacccaaagaaacaagctattttcactatatgtagaaccactgtggtttccccatcaggaggtttatttgagcattttcgcttgacttgatttgtacaccaagaaacagagaaaaataagttttttttgtgtgaggaatgattcttagattaggaaattcagggggacagacgaagcagctgagtgaaaattcatggtacggtaattttttcccttcacaatttcattgaaatttaataactatattgtacataattgcaaaaaccaagattaatagcaatgtatattacctgggagatagaaggggaatgcccaggggtagaggcaaaccaaagaacaaaaaagacaagaagggataaactgaagaatctgtgtatgaaaaccaaagcctgaatatagatgataaaattagctgatgtcagtgaataagaaataactgcaaggatatttgtagcctgtattgttcttcagaatatttcaaattcttaaaatgtagacctcatcatcgataaacaaacggaagaaagctgaggacaagaatctggtatttagtcaaggaaaagctagctgaaccatcttaaattaaaggggtttactgaagaaatacccaaattattgcattcctgtggtaaatatacagaagctcgcacaacacagaccagaattatttttttcttctcaacagacaaaagaacacaaattcaatgattaacatggtactctaaagtaattcatcaactg

SEQ ID NO: 109426 - DNA, 624 bp, Oryza sativa
tctcacaaatcaaaggccagattgttccagagtttgtagtatgctgacagtgtgacacacacagatgaacacggttgaggagcaagaaaggagagaagagcagggagtggcacatgcgccaaaaggtacagaggtcctatgaccacaccacccataatcctgttctgaagcagcctacctgtaaacagctagcttgctcttctttgcttctgtaattgtgttgctctgtgccagtgcaccccaccccctcgtcctgactactcctgacatcgtgcttgctccaaacaaaagttcacatccaccaaccatgtattacattgatgaacaagcactgcaggttaggacgttttaagttttaattaactgagctgtgcttttactgaataatcatattctgaaactgcaaattgggcagggaggattgaaatccgaaatgcacagtacaggtatatgagctgaaatatcctctaatgaaatacgctctctgggacagttgcacatgtatgtattaattaatttacaaccaagaaagacaaaccgacgcatttgtttcttggctcaagtactgtacctgagggtgatgcggcagttagggcttgttctcttgcccaatttgcacatcac

SEQ ID NO: 109427 - DNA, 2167 bp, Oryza sativa
aagatccagaggacacaaaaaatgctacatatttttttctctgactagtcagatcacaaaactacatggactcgaattctagcccatagaacaatacaaaaaattatacaggccataactgcaaatacatcacggcccataatgatcaacttcacatccaataaaggtcagaaaaaaaacaaaatatcacagggagacccacaccagttcgcacaaatcccctagatcgagcaaaacaaatcgagcacgccatagacagtgaggagaacgagaaaaagaagaagaagccaattcttacccaagaacattgaggtcaagaagttgaaatcaacaagacataatctttcaggtaacaaattacctagcacaaaatccacctttacctttccccattgacttcaccatattctgccagtcatcttttaaatcaaacaaaaacaactcagttctgtaaaaatattggagaaaagcacttggaatagtgaatttcttttggagaaaagtgcttggaataggaaatttctttagatcaagtagttaaaagtatgtaactttttcagaaaaactcgtaacaaaaactatcaatctatagtcagttacagttacaaataacaaaagttacatatataactacagtacatctaaactgtaactgggctgtaaatggaatcattcttaaatttcttaaaaaattcagtacttatactgcgacattaaaacatttccccaattataacaaactctaaattatgttacaaatatataaagagctatctatctatagtcagttacagtgagacataacaaaagttacagatgtaactactgtacatctaactgtaactgggttgtaaatggaatcattcttaaatttctttaaaaattcagtattcatgcagcaacattaaaacactttcccctagtataacaagctctaaattatgttacaaatatataaagaactatttatctacggtcagttacagtgagaaataacaaaagttacatatgtaactacaatacatatagactgtaactgggctaaaactgcaagcatgcttgaatttcttcaaaaaataaagaatttcttcagaaaaggagtcactttgtcacaatggactgaagattttcctcaagtgaaaatcatcttcagacagtggtgtttaacaaagcacaacaattagattagagcctaggataaaaaaaaaacagagcattgtggtccaaacggtcatatctccagttgtgtacaaatttgcccatatattaaattttgtacataatttgcacatatctcaaacttctgtgcacatatattaaaatcactcgacaacaagatgtgacaagttagctgatgcagaagggaatggaccagacagggtgttgttgttgagcctcccgattaaatttcacagcaaatgagttaactgactaacaagctccacacataattaacatgggaacaatattgggatgggacgatgggtcattcagaataaagaagaaaaaaaatcatacagatatttcaggcatgtgaatacctccaggcacccaagtgaccttggttttgctaccattgaaatgcattagatcaacattagactgaaaccctccaaattatttttcagttggctgaagtatgagattttaaaaagctcatgtcgactgaaactgttcaatagcctgctccaagattcaaaaaatactgacaattcaaatagatttacgagcgtgctatcccctgtcccaattcaaaaatagtgccaattatgttcccaagttcacaaatagcgccaattcaaacagatttacgatttacgagcgattgacaatgaacaaaagttcagaagagaagaaagagcagatgcaaccaatagcccataatttctcaaagcaacagggaccaagttcaggtattggcttgctgctaactcatttagatcagcactgaaaagttcagaacatgtacaggaattttataaaccaaatagtacagtagaatacaatctgaagaaagcagaacgcatgtaggggtttggtttaatttaaccaagcaactcagcatactgggaaatcaaaccgtacatctctgaaacgaaatgattcatatgctgcagaaggcaacacaaaacatacttggggttcagttagcatgcatatgtaaaac

SEQ ID NO: 109428 - DNA, 1397 bp, Oryza sativa
atctgacggcttggcgaagggaggaggaggctgtgcggccgctgcttgctacggggagtcgatcagcgtcggggttgcctcctgctcctccgccgccgctcctacagcagcgatggcaggcgcggcggcgaagtggtcgagcaggtgcagcgactgggcgtcctccgcctcgatttgggcgtgttcgcggcggagcggtggtgccgtgggggcaaagcgggtggagggggacggccactcctcatcccgccggtgagtggtggtggtggtggtgggacttgggaatgggacgcggcggtggttaatgaatgagagtgaggaggagggaaagggaagagagagagagagagagagaggcggaagaggaggagagccatcgatgcgggcttttggaaaaggatccaactcgcgggccgggtattttcttgcgtaaggagccaaggagggggtggcctgtttttcatccttgtccatcttttcgtctctctcgagaacatcccgtatcttacttgtcacgaaaatagtcatatttttttctaaacaaatattaacaagatagattaatataaattataccacttcataagcatgcatattaatataaaactagtttaatctatcttgttattgttttaattcacgttcaataccggagacgtatagcttgttgaatataaaattgatgatgcttttaattttaattttgtggttatgtttgaagttgaacaattttgttgtttgattatattggtcaccaaatgaaggatcgatccatggatccatcgtttgttttgcgttttaatttgctatataccacattagcgccggcccgtacgttgtgtgtgtacatgtgcatgcgtaataatcttgccgacgtggcgccacatgacgtccgttcgcccagtctgcgcgcgacacgtgtcctacctgggcccgctccacgcgccagttgagcgcctgtgccaagacaaatatatgggccgagtccctgcacaaaaggaaggggatttgttgggcctagcccaactctctttcattcaaatgcccaagcgcccccggcctgtataaaggcagctacggctacccatctctctctctctctccagtctcctcctccttccttcttccacctcgctccccttccaatccctctctcccccaccgtttctccctcccgcccgccatccatggcggcccgagcgggctcccggccgtggtgggaggcgttcacgacgaacgtgaagaaccaggggtcgctggtcatcgacatgctcaagcagcttgttcatcgggaggaatcggagtcgcgagacgaggagaagctcaaggaggtgatcctcgagatgaaggagcagagcaacaagagattcgcgggatggtttcgctcagagctggcc

SEQ ID NO: 109429 - DNA, 603 bp, Oryza sativa
ccgcaacgatggaggcggcgccactaatctgtcacccagcccaacgacgtccgcatcaactcgcgcatcgccaatctctccgcgcgtccgcgaccgccgcggcgatctctaacatttctccatccgcgaagggcaattaatgatcgggtgagatgctctaagttatagctgactggtaggatcgggatgagttcgaactatgattcacgcagttggattagttactggttgaaatgagatttttgaaagcattttcagcggcgatttgatggcaagatgctgcgttcatttgaaagtatttctgtttaatttgtcaatctgggttgctctgtttttgacgcaaggaaggttactctgttttgatgtttccttttgatgctgctgctaaaatttgatttgtttgctgatgtgatgtgctacgctaactttagttcctgcaccattttacctaccttagtacgtacatcattttcctgacatcctctgcctgccctgatggaacagaacagtagtgattttaagtccgaatgttggttgtgttaaacatagtacgatcgaatacagttgtggcatgatggattcaaattctgcaatgcagtggct

SEQ ID NO: 109430 - DNA, 512 bp, Oryza sativa
ccgccgtcgagctcgccgtcgcgccggccgccacctctcctcctctcccgcggccaccatccctgctccgccgccggtcacctctctctcccccactgccgacgtgcccgctcatgagtcgtgtgaacccggagagaacagaagagaaaaagaaaaaaaaaaggagaaatgtgggacccacaccattttctctcacttacatgtgggtcccacaaataaattttacttattttttataactagtatgccacgtcagcgaaaccatacctctatactgccttgggaccttttatatacggtttaacgtagtttaggggtatacatttctggttttgtggttaagggacttcaaaaaatttcggtgtaaagttaagggatggccagtgaacttattcctaaatacattgcataatggtcgtgggccaaaagcaaatgtactactatcagttagcaagtgggccaaaagggtagccgacatatggatctcaatacgtgcagctcatgagatagaa

SEQ ID NO: 109431 - DNA, 634 bp, Oryza sativa
ttggagtctgctgctcttctctcttatcttttatctcattaaaatatgtttgcagccggtttatagcttgttattgtacctgctcttagcagcaaaatggattggttaaatcatcatatctagttctctggtatatcatatcatacttttctgcttgttatagtatcgaaccaggcccttgggtgaagaatggaaggaaagtggtaacttgtaacacattagccaaggccgtgccaccctccatgcctccggccaactcctactttatacctaaagtcttttataagggtgaaaagtccttatcaaccttctccctatgaatccttcacccattatataatcataaattcatcattttgtctgaataaatttcaaatattgttcttctgaggtctacttatatcttgaaaggaaaagacagtattgtccctcaatatattggtcaggtgttcctttccttggtaatatgcatagtattcatattaaaacagagtttttttgcgagaaaacgcataggacagcaaattttcatgccattttttttttcaaaacatatcacagttttttttaggaaatgcataacaaaatatcatgccaaaaattttcaaaacataggttattactctagttacta

SEQ ID NO: 109432 - DNA, 825 bp, Oryza sativa
tggagtactaatttttcttcaaagttacgtctgatgaattttcttcagtttttttctaagttacctgtgttatactcctacataaatttccttcaatctatgactggcattttactcgacaccctcagcctaattatgctagaagctatagatggagcttcatgtgcctagcaccaacacagaagtcatataacatgtcgccgttcaacatgtgcttttgcagcatgcagtataaggtgtggactgatgacttatcaaatcaaccaaaaccaaacatttgtttctttgtaataatcaattaaacagtgatactgattgcgatactgccattattagaccacgcagatcgaacccccccaagtcatgaaaaagattattcttcatacaaggtaccgttttatccacaaacaggccgtctggcacaatcagcttcgtcaaaatcttgtttctttgcagaatccaagataattaaaataagtagtgagtggctttgatgctgcaaatacaatacaaggcaaggcactgaatattctttgaaagaaatggctgccatttcctttgctttgctttcgtttctgcttgggctcaccactcaccaccagcccaactgctcccactctgcatcttacttctgtgtatgcatgcagtcgagtcaacatacatcaattggctggcaagcaccatccatgcaaggattgagcacaattttctgagtcactaatctttggatgcggcttgtgaaagataccaccatattctgcagttgtatgcaaatgccatatcaattctaatgagcggatatgtgacacaaacacttgaaaacac

SEQ ID NO: 109433 - DNA, 721 bp, Oryza sativa
tccctcccatttatgatctacaacttggtgtgtttagttgatgcacttggtaactgcatgggtgcgcatgcactccttcccccccgtggggtttcctccaacaccggaaaagatccctcaccaccgtaccacaccacactagtacagtatatattatggagtttatcccaaattaaggggggactcgtccaatttcaaaaacaagggggaaacccccaattcaatcaatccggcggggggcttaattaattttgtcgccgggcggccttttcatttccaatccaatccaatccgctccggctaaaccttcaccttaatcccttggatccttgggaacttgccttccgcaactggcgcgcttgccaccgggcgggttccaacttccgctcccgaacccgctgctctctagagcacgacaagacaatccggtcgatcgagtgtcgagtcgaccacagcggcccgctccgtcgtcgctcgcctgtgttgctaggacctccttcccgtgccgcctccccacctttttcccatctccttcaagtcaggaacggcgctcttcagggcgacgcacagcgggctgaaggcgtggctggttgcgtggagaggggcgggggacaacaagaagaggggcagcggtcgccgacgggaggctgcgtcgtagggtggcagtcggaccggagtcgcgcgactgtctcgcggccggccggggaggagtcagcggcga

SEQ ID NO: 109434 - DNA, 520 bp, Oryza sativa
gtacatattcggcccaaaccagaaagggaggattttgattctttttccaattaaataattggtgaaatgatctttcgttttttttttggttcatgttctcaaaccctagctgtaccccagaaaacggttcagtttgctgacccgtatgaggtcatgatttgaattaaatctaattctaattataaagataaaacttatatttgatcaatctacatcgttatatctaaacatggaccaaaactttttctagatctactatgatcaacggcgtatatttttctttaaataacatgttgttttctaagccacaaatatgaataaatatttctttaatactgtaataaaataatttataaatctatggaaagaaacatatatatagtgcttccacacggaaagaaaacatatgttacaccaggttatgaaaaaaaatgttattttaaagttatttaatatttggtgtacttttattttttttcatgttgcaacgcatgggcaccttttctagtaaatatataaa

SEQ ID NO: 109435 - DNA, 656 bp, Oryza sativa
ttcaaattgagatgtgataacgttgatatgtacagcatcatattctagtctaggataactattcgttttacttgaaattcgaagcagattgattctatcagttaatgcaaataacagtcctggaatggtcatctttgtcatttcatatatttgtgctctgtggcatgatataaagagtagtattcatataatttgaatatcccgttgcaacgcacgtgccacgtgttctagtgagactaaaagcgggagcaaattccgcttttattaatcttgctgttctactatcttgctgcacaattttatcaatcttgctgttttacaagcacgtgttctggtgctacgatccccagcttgcatgatcaaagatggagtttcttcctgtcacaagcacttcacaattttatcaagggaatcttgctgttttacaatctgattccaagttgatccaactactgtatgagtactgaacttgcatggtgccatttattcaggactaagttaaataagacagtactaaaaaaacgcaacactatgccactttggtatgttcaggtctttgttagccgaatatacagtgcggaggatggaacagggtggcattgctgactgctactgctaggacaacaattatttggataaactttcttgattgttgc

SEQ ID NO: 109436 - DNA, 544 bp, Oryza sativa
aaaatgtgttcagttcataatgtgatgggtttgcccgcatctcttttgactttttttgtgaatgacagaatgatgcatgctattggcttgttggaaaaactgttttatagttcaaacaaaccaagtttcatgtttgacggagccattgtttcgcttattcacggaataagcgaaacggcatatttgcaaacgaaaagtaatttgtgaataaaacttttatatatgtgttcttagcaatctaaaagcaaaggctgaaaaataaacttcgatgaaaaaatctcaaaatcagctccaagttcaaggttggaaattcaaattttggctgataagcataagcataagcgaaaagatgaggccgtgaggcataagaccaagcatcaggtccaagataatgaaaacttaacagggtttgcttttatacttcggtgtttttttgtggagttggtctgacatacagaactgttgccatgtaaatagagcaggcatgatagattgatgtaatgttggcaacttggcagagaaatcagttatgggctcactgttc

SEQ ID NO: 109437 - DNA, 1124 bp, Oryza sativa
attttaagttatctgagttgttagtaaaagctaaagaatttttgctgactgcatatgatagtagtaacttggaaggtgagtaatctatagtgtattaaccaacgaccagcatgatcttctttgactagtatatactaaacgactgaattgtcgatcctcgtagacatattttgcccatgaacgtccatgtagctactttcgagtttcaatggcgctttccaaggccatgtactttgattaccatgatcatcatttgataatgagcagcttgctaactgcatgtgttagcctagctcccttaggaaaaaggggaaaaaaaaagaaaggaacaactacaaaagacacacatatatacatagtacaaaaaaccagaccggaccgacggttgaaccggaaccagaggtctggatggctcggtttgctgtaaagaccgcccctgcatttgaaccggaataaaccgcttgaaccggatggttttcatgtgaaccggtgaaccagaaagaaccgagccggccggtttgtcatgccaagagaggatgggccagtcaatgccttgtgcgcgcaaagatctcaaggcccacggtgaatgtgtactattgaaaatagcaagaaaaatgtggggaatggggttcgaaccctggttggctggctgttttcaacggaggatatgcaacaatataacacttccggttcaacattcgaaccgtgtgaaccggcgggtgaaccgctggaccggtgacccagggacttgagcgggtcgatcaccgattcggttttttcaactatgcatatatactccctctatcctaaaatgtttgacgccgttgacttttttaaacatgtttaaccgttcgtcttattaaaaaacttttgtgaaatgtgtaaaactatatgtatacataaaagtatatttaacaataaattaaatgataaaaaaagaattaataattacttaaattttttgaataagacgaacggtcaaacatttttaaaaaagtcaacggtcaaatatttagagaacgagggagtactatgcattatgcatatatatgtaggcatgcatgatgatgctttagctttacttaagcgtgtataactgttggacgcggtccaagtgttctcac

SEQ ID NO: 109438 - DNA, 695 bp, Oryza sativa
aaaacatgtattatggttctaggaaatgcaactgacctttttagatcgatgacaaggagccgaggatgaaataggccgagtaccctgagcctcagaggttttgctagtcagaattcagaaaaacaacaaagaaaagtgcaattagtatttcagatattaaagtgcacccactgtaactatttgttggctgtgaatgaactaacagcaccaccctttctcagggactataatgagccttacaatctcaacatacagattttttttacgggaaatatacagattcttcacagtaatgcagataggatgcccacaatttccttgacaagatttgcaattatctgggtaggaacataacagttatccttctacttgagtcaaagtacagccatacagcatcatgctaaagtggtgacagtgattgtcatggaccttttactcttattgtaccatttccaactgcaatgcattgagaaagaacaaaagtctggattacttccacattcagtttaatggaactgattttaaggttaaaccaagaaagtgatccaagggcccaaccaccccagaccccaccattagaagattgcaggggctttgtcccataagtcaatttgcccaacaaggtaatagtgccgtttgggatgaagcaaaattattacgaaatgcaagtgaatgaaatctgtagtaggtgcatg

SEQ ID NO: 109439 - DNA, 1193 bp, Oryza sativa
catctctccctagatctctctctgtggggaaacacaaatcaagagagagaccagctgctagcttagctagtttgtaatgggcatctcgatcatatatatagatcgatcaatcagaagctcgcatggtcattatatatatacgaggggggcctgaaatatatatatatatatatataacgagtgatatcgatgatatgcatgatgatcagtgggcagtacagtactttgctgtgtcgtacgtatggtattgataattgcaattgttggggtgtgcacatgatcgatctgcagtactggtgtgttgcctgacagcctgaggatggatcctaagacaaaactaatactctatcttgtttttccttgtctctttgccttcttcgttttgttctgcatgcacacgttccttactattttattttgattattgcaagaggatcatccactctgagcaatggagtttgagtagtacaagcgaagcgagaatcgtcgtcgtctcagctatatatatatatatatatatatatatatatatatatatatatatatatatatatatgcttaattagctcatttattttccttctaattgataacattatatgtcgagacgacacacggaaaactaccgactacagtagccttaattacatactcctacttataattaattagcttgatatcgaatatcgtacgtgttgcaaatcactctgctttaaattctcctgatcgagctcctgtcattttctttatcccggatcacgtaaatgtacgccttttatcaggcacgtagtgattagctagctagagctttcggtccaaccgcgtcaagtagctttcacccaacaatatacattagccaatacaataaactgataattaatcaatatatacacatcgaacacgtcttgttacacaacatgtatacaaaatgcaaacagatcaatttgttttctagtgctatctatgccggggagaacatgtcacccggcctaacctaacgtgttctcctcctagctcagaaatatatactctctccgttctaaaatataagtattttttagcataatgataagtcaaacattttaaactttgaccattaatagcaaaaaaaaaataaaaaagatcaatcatgtaaaattgatgttactagatttatcattaaacaaactatcaaatatacaactctttttatt

SEQ ID NO: 109440 - DNA, 707 bp, Oryza sativa
aacttttgaatgggccatgaaatgctttaatccaatgggtaaatgagagatcccctttgattctgttaattcctttttcattcgtgggatcgcatggtgagctctaggataaatgtcattctcgtatccccaattggatttagttaaccatatcagcaattaagcttgcaaaccacattttacatgtagtaccccttgcaaagagagattttccaataaacgtgcagcgggggatcccatccatctttctacctataataaattagaaaaaagagaaagaaatggagacacaaaaaccggacagaaagaaaagctgatttgagtatggttgtcactgaactgcatgccccgagctaatgcttctccgattagcaacttggcactagtgcaaccctttagttgcttccccatgcaaaaaaaaggcccacttggaaggggtaacgtttcccttggaacgaaccaatcagtttttttggttaaataaaaaaattaagaaaggggggcatgcacccaccccatttatatttctaattgtagttaacaaagtgagagctccctggttagaccacgtcttctcctcagcattggcagcccaaccccggcatgcttgaaatagatttttcaacaaagtttgcttaggaaattgcagagatagaaagaacaaatcaacgtaaagagattttgcactcgatctggagagctgcaga

SEQ ID NO: 109441 - DNA, 1537 bp, Oryza sativa
tttgcagcatgatcaatatacatgacatgaaaaaaaattaaaatccatacatccgtgcatatggtgtgtttagttgtaattggtctgatcagcttttttggtctcgtgagctctgactgtgctccctccaaatactcttaccttctctcatcacgggttctcatcaaccaatcatcccttccaatatcgatctcctgcagtcttcaatttaattctctctccccacagctagctagcgacatgtttctaacttctgtatatcgacatgcatacatattgcagattgttttttttaaaaatatactagcaaaaatatttgtgcgcagttgaaaacaattttcacgattgataaaaactttatcaatttaaatgacaaaccgaaacaaaacaaacaaaacaatgacaaaacaaagtcagaaatcttttatagcattgagtaagctcgcttcatacatcatcatatgaagaatccttcatgtatactgttctatagccttacatatcgattgggtggctattccataagttgacgcatgcgtattttgctataccttattgaccaaagattaaaattttaattattcaatttacgaaaaaatattgttggtggaaagcattcgcaaagtaacaaatttgcagcatacacatcttaaacaattataattttaaaagaaaaatatttatgaggagagaagtttggaagagaaaagaaaaagaggaaaatagagaaaatataagagattggaagaggatcagggaaaaagaaaaggagaaaaagaaaaaaaaatagttattctagactcacatcgaattagatgaggacgacctataactaacttaaaaactaaatgaaatacggatgacgtaccaaaattttgatataaataatcttcagtttttataatagcatagatatatctagcacatacttcagattcactcataaattaatacaacacaactagtattgagaacctcggcctcttaattttaagtttctggtgtctgtgctatgaaccactctcaattttatttttcgttatatatccgacatggcatatgttcatcatatcggacgcttgaaagtcgaaatcgacatgtgtgaatctaatagtaagcacaaataatcacatgtacatgttgaaactgtgtaaagcagccacatgatattcacattttgaattatggtagaataatagactgaaaatgtaaaatacaattaaaatttacataccatagtcttcagaaagggtgtttggtgtagtggtatgattctcgcttcgggtgcgagaggtcgcgagttcgattctcgcaacaccccttaatcgttttttttttctttgaagccctttttttttcctctctggaactgctctgaattcatcctgtgtgtcgactgctgttttatttaacgctaagtttggtgtacatcttgggcttgagacgacagaatataacattttgtcatcatcgatccatggcgctcgtgcatatagtgcagtgcgacagtaaacaaattaacaagagccgtagcaag

SEQ ID NO: 109442 - DNA, 834 bp, Oryza sativa
cattttattcttcagcccataaccgagccgatctatgtgcagcccatgaaacgagcgtggcccagcagtgatgcggcccgatgatggaggccagcccgacgtgggagcgatctaagccgttcattttgatggacggctcagatcggctcctaattcatcgaaacccccggatcaaataaccctaaccctaattctagttttcccctttctccccccccccccctttccctcccctccacgcacgccgcctctctccccacgggcggccgcgccactcccccacgggcgcacctctcgcgcccctcccccaccggcgacgcctcttggcacccctcccccacgggcggcgcctttccgcgcccttccccacaagcggcggtgggtggtggctcttcgccagatctggcgccggctctttctctcctcgtcgagcaatggccgtcgcccctctcctcgctagatccggcgggccgacggcaaggttgcgaggagcagcgcgcggcggcctccggctcacccctccatctcatctcgtcatctcatgttaatattttggatgtttttttttatgattccgatttagatttggattgggattttgtttttatttggattgtgatgatttgagatttggagagaaggtgtgcgtgcgattctgtttgtgcgatgatggaattccgactggatttgggggggggtgtttgggggacaaaaaatcacggcacaaacgaggtcacgaaaggaaaaatacgaatcttttaattattatattatattagttaagatctatacctacctacctctctactattataaaaattaaagatgtttttg

SEQ ID NO: 109443 - DNA, 1166 bp, Oryza sativa
  unsure (1)..(1166): unsure at all n locations
aaagcaactgtacaaacgcattaggagtacaaagatgaatcaccatgtttattttagataagctttctcactctagaacaatcaacaaataataaattttattgatcaagtccctctcctccacaacttacaggtccagcatcttataacgcagacccggaaatttaatcctctacaaccaatcctcaagttttcacaaatcaaacgttttaaatgcataaaatcaaactaacccagaaaaaaattaaaaatntaaaacccctttcccccattgggtataatcaaacgaaaatttacggggattttacagactatcatgtgttaaaacccactttgcttgtataacctctgttacaaaataatcacccttttttggcnnnntnaagcagaagctannagatntntncttaatganttcttnctaacatttgcacgtggggagaaaaaatacaacaatactgggagtgcatcccataaacatgaaaaaaaactgccagctgcaggcagatgtaaattttccccctcactaaaaatcaaccctactacatttgaccaaatggttacctatccancactccttttttgcacaaggggagatttttatcacatcccgcggatcaacactaatggttaaacacaacacaagtgccacacagccagttttcatctgcactaccaaaccaatattagtaaatagcataaaagcaataacatccaccagtacccccgaaaaaaaaaaggaccagaaatacaaatagaagtatatagaatatccaaaagaagcatccagaagaaaacaaaaggtattgggacagatttctgaccaacgtagacagtcatttgaaaagcaaagctatttgttgatcagctacttntagataaaantgnccacaaccatgctcccattaattggtacatgggctctccatcatgtcaagtaatttagaatattctcttttttttttatgaatcacatgccacaaactgggttattaaagttcaacacaatggtcccccccccgcccttttttaaaagggaattaaaataaaaataagatgcaaatcccactagggacatcagtcatctgaagaggaaagaaatagtttaatcaacatgagtgttcttatgttggaaccaagcatttccacgatgtccaaaaggatat

SEQ ID NO: 109444 - DNA, 747 bp, Oryza sativa
taagttacttactctgtcctaaaataaatcaatctacgtgacgatctgacacaatcacacaatctctttgtccagattcattgtaccacctagattggtttattctttatgtattatgtatttattaggtttattatatataatatttaagttttcgtataatcaagtagataatctatcaacatacatatgcgagcaatatgtttgaaacactaattctaaaagtacactttgaagtcaaggacggaggcaggagtttgctaacctaaggctcaacaaatgtaacttgttagattttcaaaattttcaattttttttggatgaatttaaatgggattgatttagcaagcgcactttatagtcgttatattccctcctgtccgtggggcccacagacagacaggcaccaagcagtggcaactggcaaggccactggttcactgggcctggacgcaggcaggatggcaggagacaggagtcccagcagccacacgccacagtgacccactcccacacccaactcagcaatgcacagccacaaaaccaaaccacgctctttctttcttcttcttcttttttttttccttttcttttctctttttttgcgggagaaacctcgctcatctcatctaagccaccatcttgtttttttctgaacgaaatttaccatttcatatggatttcctctgctatgttttttttatttgttcatggctcacggtgctcttttttccgtacgatctgtca

SEQ ID NO: 109445 - DNA, 564 bp, Oryza sativa
gctccgattcgctgtacatcgtgagcacggataggcccttcaatttgggtcttatatacgccatcgagctagatttatttccttctcgttttcttgccacatttgatcgcgaagccggtttggagaattttggagattctgctcatgttttccagtgagtgaaatgtgactgttgcatcggctggtgccatgtgaataggtatctggtagatttggattttgttttcttgcctgcatcgaacagtacaaaaatcttacgatgcattgcaagtttgtagttctggtcttctggaatggtgaggtgttaactcttaaagagtaatttactcttcgaagaatgatcccattcccataatgtttgtttccgatgaagaaaacaagtagtgaaagcagtagaataaactttctagaatctagatacaaagatccatgttgcgtggacgcatgtgtccctgtcggctccaacaacttcaggggaaaaaaaaggtgaacctaattctctcctcgtccttggtcgaactcatccatgtaactagtaccatgtagcagcagcaattcgcattt

SEQ ID NO: 109446 - DNA, 655 bp, Oryza sativa
ccttgatctggtcctctcagtgccagctcgtggcgttgaattctttcctcgtggcgtcgaactcttatcggtgattacatggacattcctgtagaggttgttcatggagccaacttttcttgttgcagataacttggatagagcctgaggccgccgctctttcggaacgtccttgggagaaagtctgactcctttgtgatgatttcatttgcagtgcatgaggattcttctactccttggcttctttcttgaatcttgattgtgtcaacgatgtcacttataggatgaactgcaacctcttccgcttcaatgcctgaatgtgactctttggtttgatcaccatgtggtgcatcctctgcgtttcttccaacctgtatttctctttcactgcatatatctctgtgattactcgatgtggagaacgaggaacaacttgatgactcttccaagggatgtgattgtacttcttcctttccaatgcctgaatgtgactgcttgagttgatcaccatgtcgtgtatcttccgcattttccccaacctgtattgctctttcactggatgtatctctatgattactcaacaacgaggaggaacaacttgactcttccaagagatgaggttgttgagaaagatcactgcttggaggatttggtt

SEQ ID NO: 109447 - DNA, 529 bp, Oryza sativa
caatgctagaaagtcttatatctgaaatggaggtagtacttttcaaggatttaccaagtactcaaatgaaactgggataaacatgcaaaaagaactatgaaacataattaccaatacttagtactccctccgtttcacaatgtaagtcattctaacatttcccacattcatattgatattaatgaatctagacatatatatctatctagattcattaaaatcaatatgaatgtgaaaaatactagaatgacttacattgtgaaacggagggagtaattagtattacacatataattgaatagaagtctcaacatatatttttatggtcataatattttgtaggctgagctaacagttctgagttatgcacttcagcaggcgaaaactgaataatgcgagaataagaaaaatctttgatggtaaaaagataggttataaaaatcaggttaaaattctcgtgctgtaaaggacaaaaacccttcatggtgataagaacaggtacctgtagtcgtaggtcaagggttccccc

SEQ ID NO: 109448 - DNA, 752 bp, Oryza sativa
agggtggtattaactatcaaatgtcaattataagaagtacaaaatcatggtccattgaaattaggaataacaaggactaccactagtaatagagaccagaaggcaaattgcttcccagtacagatgattcacatgagacacttttttagtgaaagatgcacaaaacatatcaaatggcctgcttagtggctagtcatatttttgcactacaagctaaatcaaacatagttaagcatgcatggtcaactggattagaaaacaaaagaaattgagtaagaaacaactcaacgctaagacaagtgggtggctccgagaatacaactaatatttgggaggacacaaaccaagttttcagtttatgtgattcagtgatcactgaggaacaacatagactattataactagaacactacagtttataaagtggatgggggaacaatcttgaacatggaacattatctattcgtaacatatggataatcgattaaaagttttggaaaggggacaaaaagcaaaaaaaaaaacaagataatcacagacacatggctcaccgaattaaaagatgcattctcttcatctgctgtcctatcccatggaggtcgataccattcctcgatccgatctttcacaggcactctaaacatggatgctcctgcaggcattgccatcggtcctcctaccaaagctcaccatgaggcgaagggaatgtgtcaccgcggaccggctggaagctgacggacaatcgcgagggc

SEQ ID NO: 109449 - DNA, 792 bp, Oryza sativa
acatcgctcatccaaacatgcccttagtttgtaagggggtgtttagatctaggggtgtaaagttttgacgtgtcacatcgggtattatatagggtgttgcattgggtgttcaggcactaataaaaaaaactaattacagaatccgtcagtaaaccacgagacgaatttattaagcctgataaatccatcattagcaaatgtttactatagcaccatattgtcaaatcatggaacaattaggcttaaaagattcgtctcgcaaattagtctcaatatgtgtaattagttattttttagcttatatttaatacttcatgtaggtgttcaaatgttcgatgtgatatggtaaaaaaaatttagagtgggatctaaacagggcttaagtaccttgatgtagatgtggaaaaaagctcgaagctcgtggtttggattggctcatggtgagctactgagctcgactctgattgactcaaacccatggtcttaatgagttgagccaagctagaaatttaactcttgagcttaatgaactagcttgtgagttgctcattactacaaaagatcaccacatcttcatatatacttagtgtttcttaactagcgagtagtgactagtccattagttacatcaaaactatttgtattttgtgaattcttcactagtgtttattattaagtttatatgttgtaaacaaataaattactaattataaaggtgatataaatacgttaacaagcttgacaagagccagctcatgattttttgctcactttttctctcacttctgtatt

SEQ ID NO: 109450 - DNA, 629 bp, Oryza sativa
tcagttctagcttcttgacagccaaaacttgggaggccttccctttcggccatccctgccggcccatatcaattctcccagcccatcccctgaataggcccaaatttgattcgatctttcagcccatctacgggaacaggctgggattgtgggcctcccgaaacaccctggtcggagttgagagttcagacgtcgagctcgaactgaaacatgggcgccgcgtacgcgcccaaatccccgaacaagaacgtgtcacctccgggtacccgaagccgtcgtcgtccagcccgaagtacgtctgcacgtcgtccgggaagctgcacctcgccgccgccaccgacgacatgtcgacgttgtactggtcgtccttcggtacggttggctgctgctgcggcggcggcgatggcaatggcgacggcgacagcgatgacgacgacgaagaagaaggtgagtctgtgctgctgctactgctgctaccagaggacgacgccgccgcggccggcgcctgctcgatgatctccttgaacttgggcgaccgcagcagcagtccgatcggggaggtggacgccgcgcgagccaacggcctcagctggggcgggagctgcgccacgaggtcgtcgtcgtcgtcg

SEQ ID NO: 109451 - DNA, 699 bp, Oryza sativa
aaaatagactgttaaagtaagaggagtgcatgcggtgaagcaataccaggtttgactggcctatattttctcttgtcatgtctttgtcatgttcaagttcttgctcctcttcccattccttgattttatacattatatttcaaactgttcatccatacttacatcactatcgtggagttgcaagaaacaatgaaataaagagaaataaggttgtgtttttccacaatctcgcagacaaaagaatctctcctgtattttcttgtggatagcatgggcacaatttaatgatttatggcagaccgtagcaacttccaacaaatttggccgtcagaatagaaggcggcaaatatgaacttacaccaacattgttcagttatgatgatttatgagcagtcaaccaaatcgatgatcaatcctgtagtgctgctagggcatgccacggtctcgatctgatcaactaggttacttttttttggtagacttaggttacttttatttttgtagactaattaactgggttacttgtgattgtgtgtagccagcagattttgacatgaaaacaagcatccatcctggaccggttccagtttcagttcaggtagcagacaacacagacgtaacaaagtagcagacagcacaacggacaaatcagatgctgtgggttttgactttgattaaattatgattcaagtttataaa

SEQ ID NO: 109452 - DNA, 1265 bp, Oryza sativa
tcaagtaggaaaatttcctataggatttgaatcctataaatttctagataaaccctttgattcaaaggggcccaacatgccgtagcactttggtcgctttcgtagtgcagctgtgagcctgtgaaccaacacgtgtgcaaaatgaaatgtacagctgactgccgacacggaacacctgtccgaatgactgttttatatttttccgactgaccacgtacacttttcacatagattattttgttaataaaaatgttttacatcaccggtctttgttatacggcacacaaacagtggtatttttactgaataaaaattatgttgtgtgatgggaaaaattctgaaagagagagagagagagagaaaaaaaaggccagctaaaaaggctacgaagaccagttcaattatatcgagtaagggcccattctaaacagagtttgaaactttgaaatgagtttataagccatacgcaaaataagaaaaaatattactccattagataattaattaaatatatttactgttataaaatttaaaggttaatatttttttaaagaaaaatctttccaaagaaatctttatagaaagttttctttttgagaaaatatagtgtttaattatttgggaagcgtgtggtcgtagttgcgagtaaatagctcccccgtaagctcaaacatactccctccgtcccatcccagaatataacaacctagtaccggaatggacttatcctagtactactagtctatatagagggtatgtgtgctgtgtgcctaagcctacaaaaaattttacgtttataggacaacgtataaatataatcacacatgagtgctaactttaattattcaataatcaagttctacaagtatatgcatgagtatacccaagaaacaagggttttgattattaattcctccccgccatccccttctcatataaattaagatgatgttgtttataataatttaaattatatatggattggttgttcaaaagccgtggtttatgagaaaaggaaaaaaaaaggtaatatagttaatcatctagaggtaaaactaagaaactaaggtgacatgactttataagacaagaaaagaagaaggaagataattaaggcgacatgactttataaaagaagaaaatgaggaagataattagaccataaataattaagatgatatagctcaacgagagaagagagaaatggcattaactatatttagtgtgataaggtaaaaaaaattgtctctgagaaccgtaaaact

SEQ ID NO: 109453 - DNA, 515 bp, Oryza sativa
aatataacgaagcactaatgtaagagttcaaattgactaagaattctgttatgattttgctgtcagggttaatacaatagatcatgcattcgattcccagaggtgttgagggatgttgtggtgataatttattactccactagttgagcacaaaatttgacatgactggattaacaattggatatagaaaacaaattttgaataagcaacgacaagttggagtacatgaagcccagacaaactcaccgatatttgaaaccccccaacgatgagccaaagatccaattctccaatggttctgccattccttcctccctgctagggagaagtgcaggtaatcagcttagcgtctattaataggagaaaacattgatgacctcaactttagagggagaaagacaggaaggtgttccttatttttgggatgtgaatttggagtcatctgagctgagcaaacctatttactcttcaccagtctgcctggaataccaacaaacatgaggatggcagataaa

SEQ ID NO: 109454 - DNA, 518 bp, Oryza sativa
ttgtcgtttgtgtaccctggctggtcctggacagggatttaatgcacattcagcttagaaattctggttcgagaatttctgggcgtgacactgtgccttaatgagttctgttggctttaattagcgaagatgctgtcctgcagagcattcttgaaagaactcacctttgtaagcttgactgttggttgcagtctatggagattttgggtgaatcttctaggaagcttactaaagacctaggagtatgacttatacgctccacccaaggggtagtctacagtcggtctaggaccagataagactctgagtgaaacttgcttgcacaagacttgcaattcaaggcgtagtccattgttcaagttgtgagtaagtgtagcttggagttctaggtggatgttcaaccttaatcggtctccatcgaacagctggtatataaacagtacattggaaaaggcaaatctacgagggattttgagatttggtgggggattgtggaattaatagatgggctaaggccc

SEQ ID NO: 109455 - DNA, 547 bp, Oryza sativa
tcatatccataacaatagcattattgcttatcgatttcacgggcctccttctcttgtatatccacaaaccctacaattctccatataaaatgccaaagaagaaagataaaacaaaacaatgttcacctcagaagctcatacatacatactcactgcatcatgggccccctttggaagatcaaaacaaagcctcttctctccccctctccccttcaccccaataggccaaaattgatcactgcaaagtgggccccacctgtcagcttccatggcatgatcatttcatcttcatccaaaagatgcccaatattgccatggcattcagtcacatcactccccgcccccggtctcctttccctcctccatcacacgagaaaaagcagagccactactccactcgctcgacggctgattgcctgcctgcctcccctcacccctgcttctccttctccctccttctcacttttcttcctctcgggcgcctctcctctccatcattcctcccactgctccgctcccccattccaatggactccaacctcttcct

SEQ ID NO: 109456 - DNA, 1018 bp, Oryza sativa
cttttttggcctttttttttttttttgctttttttccctttttttctgattacgtttcttaatctttagcacacatgttttttaaaaatattttgatttgaaagttttaaatcttgacttaaaattttttcaaatcttaacttaaaaatttttaaatctcgagttgaaaagtttttaaatctgagttgaaagttttcaaatctcgagttgaatgttttcaaatctgggttgaaagttttcaaatatcgagatgaaaatttttcaaatctgagtgaaagttttcaaatatgggttgaaagtatttcaaatttgagatgaaaagttaaaagtttttaaaatttgacttaaaattttaaatttcgagttaaaaggtttcaaatatgggtttaaaattttaaaaattcaacttcagttataaatttcttttcaatttgttattaaaaaaaattgcgaaaaagaaaatcctaactactaccgttattaccttttaaactgtaattatagtcttgtagaactagccaatagttattttgagagttattttttttagcacaaggaaatagccattcaataaaatagctctaaattgtttggatccaagtgttatttttcagagctatttggcctttaatacactttcctattaagtgagaactgagaaagagaaaaatactttttcagtgagccccaccccagatagcaccaattagcaccctttaaagggatagtttttttagtaggttatttctaaatagacttgaaatagctcatctgtttaaaatttttgggctatttgagaatatttaagagagagctaaaaaataacacatggatccaaatagtgcataagactaatagattagtctaactaccgaaacaacctgcgtcagggcgcgcacgcgccatccggaccgttcactaaccccgtaaccgtgtcgcgcgcgcaaccgtgtaactccatgccgcttgcttcgccaccactaaccccgtaacccggtgcgccaccgaccgagacgac

SEQ ID NO: 109457 - DNA, 1021 bp, Oryza sativa
ttattgcaagaaagagtagtagtagaatattgccactttaatgaaagttatgatgctacgaaacaaagaattggttgctatgcatctagagaacctggaattagtgccgaggtccacttgttatagatggagaaagaatgtgagaaaattgtgagccaactgcctcgtctatgacatgtgggtccaccctgtattggatacaatttggatgccaaattggttaagaacaaagccaaaccagtgaaaggagatttagatggttgagggacgaggtttaccaggttttgaagttgaggaaaaattaaactgagtaaagagttgagatactagaaatagacgttttctagtttaattgaaaaaaacctggacactgcattgatctatactatactgttcacatcctcacagctgactggttctgaaattatttgttatggcttcgattgtcttgtgcttccttaataaagatctgatgttgggtggatgttgtcctttgtgccatacccaaaatgaagtcctagtgagattgagactgtccattgaggcaatttataaactattttgcttaggtaccgtctaaactctaaaaagcataccatttggtactctgtttaatcattttctcttcttactcaataaaagcgataagacttgttctagtgatccccttttgaatatttctcatgcttcaatcccttcaatgctggcttcagcggctaactagctatgtagtaatatgtacttgctacattgactatatgtcagctaaaaacgtacttacaatttaaatcacaagcttatatagttaatattgactataccatgctattgctagttaacttttcacagaatatgtcatgtacggtttagtgcaatattgttacaagtaacaatatagcaataagtgcagtaagcaagctatgataccttgagtccatgataaaagggagcgatgatagtttactatgtcttttgttcaccagtcaccatgggtccatggcttgtattgtagactaatggc

SEQ ID NO: 109458 - DNA, 1929 bp, Oryza sativa
cgatggcgacaaagcaaggtggcctcgagacaactcgagatcgatcagcgtgtgctgactactggcctgatcatatcgttctcaggccgatcgaacaccctgccgtcacgacaccggcacctgcagccaggtacccacttaataaaaaattattatataatcacattaacatccactctgatcgatccataagtgtttggtcgtcattgatcgttggtcaggacgaactactatataccagctacttgcacttgattttcctggcccaaggtgtctctgggtatataaatatatgtagtagttgcatagaacaaatctgaaatcagaagcccgcatatcttttttttttttgtgaaggtgttagtactcacatgttcagacatatctgcaggatgctctctttgacttggtttgtatttttgttcagtactccaattcaaagaaccttatggagtaggagtagtaatagtagtagtacggattgaatcgtatcatacaaaatatatgatcatgagggtgacctataatgtagaacggacgataataaaggtgttcccataattgatagattatggataacacaaaattactgatatggatacattataaagctacagtaatagatagcttagagaaagctatctaataagctatactgatgcagtacaagtttatgagaaaattgtgtttttaaaagcatatagcaaggataatccacaactccagctgttaatttagatttgtgggcgaaatctgcaagtggaaatcaggacaacgttacatgccataaacttccatatgttgctgcgtaaacaacgcctgatcgagtagttgcaactgcattaacagtaaagcagcatgcatgcacttcgatcgaaccatgacatgtactgctgatcaagcaggagactgacgctgacgctgatcacactgacagtctgacactgatacacattattgtttcagtttagctggagtatagtaggagtatggtccatcaggcacacatgttctctccctgacatgaatgtacggagtaggattagcaactcgcgagcgaccaaaacagtctggccagctaccaccatcgctctttgcacggctgccacagacgacgagctggtatcgacgacacagcaaaaacatcacacccatccctaagttagatactccttcatgctatagaaaatcaatctagtaccgatgtaatatatcctaatactactaatactaagaatctgaacatatctctgtatagcctatactactagctagctgtatacttcttatttcgttttctaatagtgacactttcaactttgcagtacacgctttactatctatattatttaaaaattatgtacaaaaatacatactccctctatttcaaaatataagcattttagctatgaatctggataattggttggctagattcatagctaaaaatgtttatattttgggacggatgtagtaagatataattaaatcatgattaaacattattttaaaaaactcatagcaaaatagatgataattctataagttttataaataaaaggaatgatcaaatattggttaaaagttaacggcatcatctattaagaaaataatgttattattgattgtacagtatacaaatatgcatacaggaaacagcatgtacaagttcattagctaaagtttcacgtcattccctaactcagtctaaagtacaacacaatattaaatatatgtggtgatatagagctgctaggtagtatcatcattaatgtccaatcctgcctaaagtacagacaatggtattttcttttgttcatattttacataagaacacagtctctggaatgcatttttaattattttttaatataatatatataataaataaatacatttaatttttatcatagtactttgtaagacaaa

SEQ ID NO: 109459 - DNA, 588 bp, Oryza sativa
tataataaattagctataggttaactttattttttccattctctttctttctcaccctatgaatttaatgcatatttcttgtggttgggtgaagctggctcttgcataagagccaacactacccactttttttctctcttccacataagcatatagcttgcttatagcctattattaatcttgctctaactcatttaatcctatagctactagatcctctttcagaaaaaaaaaggtttgaagaatgcttatttaatgatgcaaataattgagcatcggcgtgaaaaagtaaatttcagtgttgtatctagtaagtacgctttaaactgcacaagatatctcttggcgcaagtaatcagcagttgcagagtcgcattttttgacttgtttctggaaaacaaggtcatggtctggagtttcttgactactgcgtcaccagtaactggaagtagagagtagtaacaggtgtgtgcgcgtcaaagcgtcgtggttctcgtaattcaatggtaatctggttgctcagataacctgtaagtttccaccaattttcagtctattgtatggcagatcattgtacatgcttttttt

SEQ ID NO: 109460 - DNA, 805 bp, Oryza sativa
catagtctcatcgtattcttcttcttcttctctaaaaaaaattgtactccctccacatccacacctccacatccacaaaagttacacctatttcacatttaagttttttcaaataagttgttcttatttgtagtctttgtacattcaaaacttaaataaagagataaattaattgtttgattagacccaagaagtcaaatccttaggatctgttcttttctccaacaaaacttagatgaaaataaagattttcgtggcacgcttttcaaactgttaaacggtgtgtttcgtgcgaaaactttctatatgaaagttgcttaaaatgtcagattaatctattttccaaatttgtaataattaaaactcaatcaatcatacgttaataccacctcgttttgcgtaaaaaacttaaacttcatcttcatcttcaacttcacgagaaaagaacaccacctaaatactcattggttgcatgcttgcattcactccttgattttataacatccaagacgatttaatttttcattggtctcgatgataaaagtaataggtgtaacttttatggaagaagggagtagttaaaaaatggcatgtagcctagtgaatttcagattggttgtttgcgggattaagttcctaatttaaatggccgtatatatccggttggatatagaggccgggtaataaatacccttcttaaaaaatttttttgtagttatcggttatattgagatgtaaaaatctctatgcatgcttgtccgggatatcacttaattaattagcaacatacatgtgtgacctccgt

SEQ ID NO: 109461 - DNA, 532 bp, Oryza sativa
atggagcatattttttatgaatatattggacgcactgtttaactaaaaattgcatttctctttctcatacatgtgtgcactatgatcagtggattgtccatttctgttgcgtacgcagctgttttatccatgttggtgtgggtctgaccactacacagcggtgaatggggtcggtcctccggcggtaggatttctttgtcgtgcaggtggatttggggtagcaaaagtgcaaaaccccacggaccagctgccatctttacacatgaccgaaacagtacatggataggttaactggaggacaccgccggttttcgcgaggagctttgtccactagaaaatccacgttccaaggaacaaaaataaacggaacgccatgggagcatgtgggtataatatgagaccccatgaatgcagtgcagtcagaagactcggaacaagcataacgaggtgaaaccatcgaatccagagaagacggcagtggcaatcttgggatacctctttaagttcaatcctgaattttaattgactgcgc

SEQ ID NO: 109462 - DNA, 581 bp, Oryza sativa
catgattaggaggctctctgaattttttcctcatccggagatgcagaaagtggtgtcctcctgtcaactgcgttggtgcatgtcaagtccagggaggagtgacggcaaggatggcttcacggtggtgacgacgataatgaggcaaagcacagattctggggagacttggcacagcaagccaaagtttgcgcatgtttcaaacggaatgttgagaagcatcgatttaatagtaatttagttactaagagacaatatgttgttgaactatcagtgtaatagtaacttggttactatgagaaactttgtggcaagataatatgttatgtgagaaccatcggtgtaagagtaatttatttactaagagaaatctcgtggcgataccaataagttaattctaagtaatttatttactaagagaaggtatatgaaccaattaggaatactactatcgtaagtaatttatttactaagtgaagagttgagaacgacctgagactctaagagtgattcatttactgagaggaggaaccaaattagactctgagagtgattcatttactgagaggaggaaccaaattgag

SEQ ID NO: 109463 - DNA, 937 bp, Oryza sativa
cctgcacccacgttggatccgcccctgctgaccagtaaatgctaaatgcatgttgactctacatagcgtaattgaggtgaagaaggccttttttttttaccaggaaatttcctaccttgtaataaagatcatagcgtcaattgagcgtccatcttcttgtgtcgggtcacgtgacacataggttcagatagcactgttttttacatctaaaaaaacaggaaacaaagaaaaatatatatgaagtgtatttcagtatttgcaacagttctcatatctgttcaattcacagattcgccctctttcacttttcactatgctagtttatgctaaacatgacagaccatcatatatatatatgaaattgtttaagaaaagcatacataaagaactttatgtggcattattcggtgcataaaagagtaagatggaaaatatttgcatagctacaaccaatgcataatatggacaagaagatccgctggacgccttcatgtagctatgtgaatatcattgaatcagtcatcttgcagatagaaaatggtaggcacaagctataggtgcggactgcagaaggtttgcaatatgagcagtgaacacaaaataaggcatccctgtaaaagcacaaaattaagaactggacaccagaggaagaggagattgacactccgtggtgctaagataagatttaccagtagaagttggcaatcactatcgacttgttcatgtgtgggtgaaagaacaacattacgataaataggtcatgttgctaccgatgtgaaagaaaattcattagttcaccacttaattggaagtggtggttgttagatatgtgtatatcaatgtagccttagacttatttactatcggctcatgaggcccatacaccgctgtatatactattgctatcctggaatacaccgtactgattcagcacaag

SEQ ID NO: 109464 - DNA, 733 bp, Oryza sativa
tccactcatggatagaaacaaaaaaaatacccaaaatactctttgatcactgattcaccgccatccaacacacgctagaaaactgaacaaggttaaacgcactctccactcagcaacatcttccgctgcctccaacccaacgcaaaatcaaatcaaatcaaaacttagtaaacccacagatcaattctactaacacactggcctgaatccgcccccaattcgccacacggagataactccaacctacactacgcacaaccaaacccagattctactcaaaccacaccacagtaacaaatcgatcaggcaagacaagaacatgtcctactcaaactattccagaccatcaaatgaacaatagaagcaagcgagacaagattttttctagatactgaaaagcatgcggaaaactggtcatacttaccatcgcactgttcttgcaagagaccttctagccaacgctgaagttcttgccaacaagatctacaaaagcactagaaaatagcagcagaaatcaacgagtcccttcccaaaatgataaaccttgagtttcactcgacactcaaggctgttgttggcctgatctttcgatgagaggataagtcgataggatggagtggcgttggcggtccgactacatctatcaagggatgttgcatcttagcaatcattacaccaaatctctatggaatgcacgatcagcccaaccacaagggtaattgttcctgcaagc

SEQ ID NO: 109465 - DNA, 501 bp, Oryza sativa
ccataattacataccctaactaattatatgtatggaagctatatacctaaaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatataattgtattttgtaatacaattataccaatcaatctatacagtattataatccggactcaccaatatctaactgtaaaaatctttttctttttctccgattaacgtgagaatttctaacctgatactccttttaagactatattaataatataatataataataggtgggatgcggattactccttcgcttgcccaaatatttatgggctttgtttgttctaggacacacatcttgatgttgtgtaaccaaagt

SEQ ID NO: 109466 - DNA, 4861 bp, Oryza sativa
gcccgtctagccaattctctaacagcagcaagaaggcgatcttcctcacccatgtctactctatcaacaatttgctcctgtaaaaaaagagggttatgacactaaacatacattatcctatgctagggaacagagaggtggacacttaccaggtaggaaaatatgaagctcctgtagaaactctccccatctctatacactggcctcaatgctgaataatgactatgaagaggcaccaagcgcataatgataactgactccctttcccttttcgatagcctcagaacattatggatgtccccaaaataatgatacacagcttcttccatgggaattttctgcacctcacaaacaaataagggaatttaaaaaatatcaatgatctgaaccagcgagcaacatgacaaaaaaatgaaatgtaatttatgttctaagcaccagtttctggattttacattctctgataaatgtttgaaaaaattaattaaaataatcccttcatttttattgtttgactgttgttcagtcatagaagatgggctagatacacaagatttcctaaattcagcaacagtagtagaacgttcaagtagccatcacaatcaaatcggcaaatcctttcaattacatgcaaaacataactgcaatcaagagttaacttatgatttagagtgcatacaagaaaatatactctgtcgaatggctatctgtacaagtgtgaatgtacacagtatcatgtgatctatcatcctgacattacataattcatacacttgcgtttcagcattatcaaatgttgaaaggaatcaaaccttgtgatccacatgaggtggcgagtttgacgtgcttgcctcatccagttgctttccttgtctatctgaaagctatttacaagataacaggttaagatcatatgttctaccggacatgggcagcatctcagaaaattgatatcaagatcaaacatttcagactaggttgaatagggaatacatgttattctgaaaaaaaataggaatatatggaacttttaaacaacagatgaacaacgatgctacgacctatgagtcttctgggacaattccaagcagcaactgagccaaaggctggatctttagaccaaacactagagtatgctcagttagtttgcatataaaaggcttctataatttagagaaaccatgaccagtgatccaattctcaaatacacatccagacaaaaccttccttacaacactgtccaataaaactgaaagctcatacttctggtttcacgatttctcaccaaaatataacagcagtcataacgtgcctcaatatttcatattttcacactaaggaacttgtgaataaacaaaatatcatgtgaactaggattctcattatgacctttcatgatttatacggcatgttcaacactatcaagggttaaatggagtcaaatcttggtgatcagcaagaagtgataattgtgggtacatttgcttttcggaatttcatttcaacaatgtattcgccttccttttataatccaaaagcaattcacaagaaaacatgttaaagttcatgcgtattgtcagatttagcaccaatttcaggtaagtaatatcagaatcgaacatttcacactaggaaaccagggaacatgggatgtaaggaatattttaaacaacataaaagcatgatcacaaaactagtgttccgcaatttgttgccaattatccttagagccttcatagccaatttcagttaccaagcagccgaaggatgaataatttagaccaaacagtagagaaactttcccaagaaccgttccacatctcaacacacaagctgagacaagaaccgtattctaagcaacaggattgctcctacgcaagatgagccctaatatataccaagttcgtcacgcgtcattaccaccttattttacgtgaaaaacttacttctgatcttatcgcatatgccagacattaatgacccgcctgcctctgctgacctttttcttgaagccttcagaaaccgcgagaaagctcctcctgatgaacttctttagctgggaatcgaccttgtccttcttggcggcctaatccagcgaaaccaagaaatgctcaagaacaaacccccacaccccaaaaatactcccaagaaaccaggcacaaacgccatcaaacgcaagatagggaaccatcacctcttgcgaaccttcgacgacctttccctttcccttctggtcgccctccgtggcggcggagcccgatccgccggtgccgcggcctccgcctccgcctccgccctgctccgggctggcctcggctgcggcggtgatctcgtcgtcatcggcggagctggaggtggactcgtggcgctcgtcgtggtgtcctggtggggcgggcgaggaggccatcgtggcgtggctttgcggggaaaagcggtggtaggggggctgattcgctaatctcgcagaggcgagggggcggaggagaaatgtgtgaagggtgtggttgtgaattccagaaaagtcaggaggctatttataaaggtggcagtagtaggtgataatatagctggcactgagaggtgacgtggccttttttttcccccattttgcctaagatgaatatgaaagttactactttttttaaaaaaaaatcgttcacctcttttcaaagtataatttcttttgaattaaatgaaaaaaaatcaaatcttcaagattgactcaatagcttacatatggctccaccaacaacctttagttttgcacatccccttttccctaatcaagaaatccatctaacatcctgatctttagaaccgaacttcaaaccccgaaactttgtaataatgttcagattacgtcctacaaggtttggggtatttgaaaggttttgaataactgatatagcatgttagcatatcgtcaattattgataatcaattattctatagtgatgacaaactagtattatattaacatccgtttgtaagtaagagaaaaaccaggtgtcgaaacgaaaatcttaggtgaagattttaacatatatgtcaaattcatttatcacgtgatcaagctcatctaacatatatgtaaatcaaataaaaatcaccttaaggtgttatataaacgatattgtatagtttaggcggttaaatatccagtttcaaagtttaggatgttatagacgcatttttgataaaaaaggagaatatttgtaccttttcatttctaggtaaatgaattttcttttcatttacaatgcaagatacggagcttaggacatgtgttaataaacttcttcagcttatggggatctttcaatagtatgattcttcggaaatatttatactcggtatttcttagatgatttttttctaagctatttttaagcactatctctgtcctaaaatatacctacttcattctaaaatatatagcaatttctaactatatatcatcctttcgacttgctgagtttttttaacaactacaaaaccccgtaaagttcgttcatagtgtctcggtaccagacttaccatcattttgtaccaatttaatatggttttacccgcatagtcaatatagacatatggtggtagttgataagtttctcatccacaaacacctcccatcgtaccattcagctgtttataaacagctgccaaactttataaattatttttaattagtcgttctatgactgataacaatgaaaaaaaataaacaaaaccatcaaaagtattttatggttaaaacttatatatttgtgttcttaattatttaaaagttaattttggaaataaaagtttgatgaaaaaacttaaaattatcaactccaaatctaagttctaaaatttaaatttcagctacagctaataagtcaattaaagcacgcacattctccattatggctgagtataacactcccctcttctaacttatactctccatttttcgcgcaaacacttccaaatagttaaataatgtatttttcaaaaacatagggaaagtttttttaaaaatcatattaatatatttttatatttttagctaacatttaattaatatcgcgctattaagctatctcattttctgtaagaagggaataagttacaaacctgtactatccaactcggcctatattgtgtttgttatgtgggcctaatcattcgttctctacttctttctctctaagattgttttgtcaaagctcaaaggattaggtagtgcatggtagtgggttagtcttaaccagagatcactccatctcaatataaatcaccttagtctatgatgcatgtttttttaacctctttaatgacttacatattttaaatcacagattacttttaagatctatttgtatcattgtactctactcaaaatatataaaaaaacgagatccatgctggatatattcaaacattttattaatttaaaagtaatttatttaaattgtagaagtaacttagatatacaatagaagtaactctctaaaacattagaggtattactactaagttgaagaaaaaaagtactatgtggagtaaattcataagcaaagtatagagaatattttcaagtaaatacattaatgaaagtaaattcaataaagtttgaaattagtttacataaatcataaaagtaacttagcacaaaatgaaagtaagttgttacaatattaggcgtaaatctgttgtagggataaaaacatgagtctatctagaaattcaatttaaccagcacaaattataaatttaactaaaaacaataattaaaagtagttaactcagagcattatgaatgcataaggagtaatttaatcaaatctaaaagtaatttatatatctgataaaagta

SEQ ID NO: 109467 - DNA, 1642 bp, Oryza sativa
ggggggggggttcaaacatttgcgggaacaaacgaaactgttactactacttgtattaaggttagggcccgcttcgaagagaaggggttaacgaacgcaaagcaaatttcagaccaaattaaactattcccggtgggagtgagagatgaatcagaaatatcccatcccctgctctgctcgccagatggatatcggcagccgcgactcgtcttggcgcaaggagcggacgagacgactgagacgggagatttctctttcttttacgcaagtgataacattacaagactgctaaggttaagcaatgttcttagtaaaaccagacgaattcatctcccatctgaggtcaaatgttcaacattttcctgtgtgtgagcagtaacattttaatgtactcctccgtccctaaatataagatttttatgggaatagcaaaatgcccgtgcgttgcaccgggcaatgttatgtttgataaagtttaactgaacatttttttaatcacaaaggttttctttttgtttagacaattattccacgtgtatgtgtatgatatgaactatgttcctaacgcggtagcgtaatgattatatcataagaggaacaaacggtgaatgccttaggtcactttcacgtaagagtacatagacaaaaatttgtgtgattaaaaacttgtatttaaaataggtaagtttattataaaactaataaaaccagcttttacatacttactcatagtctcgtagtggtgacacatggatgatatatagcgcatagaattcagtatgttgtgtttcgtggaaatttttatctcaaacaaatattagagtaaaagtttcgatgattatgatgtcaaaaataaaaaaaataactaaaataatatcactcgtctattaagtatggacgtgtaccttaccaattattttttaacggaaattaatttggtagattagcaaactatagaaaattgaccgcaattaacaagtatactataattgtagttttttttaaaaaaatatcggttgcctggtcagataggcttatctctctcgctatacattacgattgaaaaagttaatgagaattctaatattggaattgctatacactataaattaaaagttaatgaaaaagttttcttggttttggactgaaagcccattccttccttcttatttagctataggctagtctgttctttctgttttcccaatatcagagcgtaaaatcaggattaaaagcccagaaagatcaccgatctgtcatcaacggtgacgggagattcaatccggcaaattaaagctgatgaaagggaaaacttgagaaaatgatgagggaggagtggagaatcgatttttataatcaattggaggaggaaacgcaagatcgacatggcggcggcgctgtgctaggattcggcccgggcggcggcaggagttcggattcgggaaaaaaaaagcgacaaaagaccagacgaaaacaaaaaaacaacggaccaaaatataccggaagctttgtgtttttgtttttttataactatagatatagatttatattttctgagtaatcgatcataatttttcaaccattttaaatggctcaaaatattgccaaagaaaattatgtacataaccaattgaattaaatc

SEQ ID NO: 109468 - DNA, 651 bp, Oryza sativa
atcgataaagtgattggtgagagagtttatccgtgtttgctttgctgggcgaacaacgtatcaactgatttcacacttctcacctcattaattatattgaagtaatttaggccatgcctagttccaaactttttcttcaaacttccaacttttccatcacatcaaaactttcctacacacacaaacttctaactattccgtcacatcgttccaatttcaccaaacttctaattttggcttgaactaaacacacccttagtcaactaccttgctactactgcagtaaactgttgttcccacatgaagtttcactcttttgtctgttgattacggagtttatgagtactcatgtgtatactgggtttgttcttgcaggtccaacattgtgttcttgcaaatgtcacacataataaagtgccatcaaatggagaaagagtcaattgtttgaaagaggaaacttcaccgagctgccggtaacgtaaatgcgaagcgactcaccggcagctctcccggcaaacttacggcaactgatacctttttttgcatacccccctttaaaaccatgggattcggggtgcattggatcttactctttagttgtattaaagaaatggtgaacaaaagatgggcgttgtcattccaccgagaaag

SEQ ID NO: 109469 - DNA, 1207 bp, Oryza sativa
gtattatgcctcaaatttgatgataagccccaatgctaaaccggtagaaagcgcgcaaaacctcttgccaaattcaccttaacaaaattgtttctcaaaagcgctaaatcacggaaccaacatggcaacatgggtggttcactcttggaattcgcacgcagatgcacgcagctagtagtaggcgtgttgatccagcgactgaagcagcagcgcagcactcatgtgagacggtgagagtctggatgatgactggcgactttgttaggactcgggaccagatgagcatgagctgcctgcctccctcccacgacccacgcacatcgcgatcgaccttgctttggcacgtgatgatgttacactgttctctactttcttcgtttcataaaatacgaacctctagttctattactatcatttttgtatttcataaaacggagtaaatagacaatagtgtaccatcacataataatagtaatagtactagagtttttttttttcttttatgaaactactctacccgtcccataatataagatattttagagggatatgacatattctagtgctacgaactgggatagagatgtgtcacattctttcaaaattctataaagtctatcaccggtctctaacttgtaccgctgtgtcatcctggtccctaaactcgcaaatcgatcgtttaggtcctcaaacttgttcgactgtgttatcccggtccctaaacttacagaactctcgttcaggtcctccaacttgttcagttgtgtcaccccggtccctaaacaggacggtctaaaatctttatatcaaaaagtaattcataactttttcatgtgaactctaattaagacaaactttatatcaaaattgtagccctcgacgcgacctacaactttgtagttgaaaagtttttgaattaaaactgtttagggtcccaaaatattgttgcatgttatagattttgaaattttaattttaaaattacattttgggacaaaaaatgacttaaaataaaaaaattcaactacaaagttgtagatcgcatcgagggctaccagtttgatataaagtttgtcttcattagagttcacataaaaaagttatgaattatttttaaatataaagtctttagactgtctgtcctatttgacccagatgatattcaaatccaaatttagggaccggtgtgacacaactgaataagttg

SEQ ID NO: 109470 - DNA, 3615 bp, Oryza sativa
cccggtaaatatatagtagctccgccgcatatatgtaggtataagacacatccatatatatgcttcaactaaacaaaatataacaacttttatttttctagcaagaacccaagcagttgaaagaacaaggtctaccatccctatggctatcaaaaacgaatgagagttcaatcacatagaggaaaggttgctatttcccttacagccccattaattagttcattcaattgttcagtgtttgtcctgttggatgcagatccaaaataaaagtgtgaaatggcagctagatggtactgggttattggtaatgggccgcttgttatgcatcatttttaggctaagttaggtggtttgtgcacatgtggatgagcatgtggcaaaaacactttaattttaagcatgcacacaaattttcatcataacaacgtgaacatattgaacccctcaagtaatagaatgaccagatgaaatataattccacccttatctgttgacataggaaagcaataatagcaagaagcaagcctaatgaaacaaaagttgctcatacgtgaaaattaattgaacaatgaaaacaattaaagcccctttaattacctttcaaaaagatatgcttgcttttgcttatataagacaaataaatatccatatcctacgtggaacaggtgcgagacatgcaatttaataaatacccatgaagtacgtcatgactactcgatttcctgactgaaattagctttgatgtggtaattacctttttgactatataatctataagtgttagtaccatcatgaccttctagggtattaaagtgacttgtgaatttgacattgaattttatgggctttatatttttcaaggcctcatgggtcacctacaagtgagaatcaatccttgcccctgccctggtagacccacgggtcgaaatctggccccgtccccaaccccataaggacaggtacatatcggatccccgtccccaacaggtattttgccacacctagttgatcctagcatatgttagcagtgttcacgtagaccataatctagatgatatagaccgcatatagatgctagaagatgggttatcatcttgtttagggcttaaactgtgaattggactttttgaccatctagtcggccaaagacgatcctagaccgtctagactacacagttagacaacattcagaagagtgtaaatcataaacttgtcgtttagactatggtctaggcaatgggccaatgcattttttatatgacgggagttgaaactttaagcccaacccaaagcccatatggtttaggtttttgactgcattccaaacccttctcttatactctaagccagtcactacgacaaggtcacgttgcctctattctattagtcaccaccctggagcttgcttccacctctctccgacccatggtttacgggagtggcttcacctatcatagcatcgttggttctccaatattttatggaacaggttaagatattatacatgtgtgccaagaaaaaaaatatgccgatagtatattgtatggtatatcgtttaaactggctagcctctagaccatgggtcactgtccatctagtgtttagcatctaggtgaacactgtatgtcaggtactttcgtatacttatatcaacataatttatcctttcatcacagctattctggattttcatattaagttaggttagtttttaatacccatatcactataatgtattatttttgcttagcaaaaagatgttaaattttcttgggctgatgacatctcgtgttaaattaccaatccgtaaccatgaaaatcacccactagcaataattacatatttaatctcatgcaagtatgcaacatcatctataatttatttatctaattctacaaatcaacatgcaagtatatctaataatcatccctcacatcatttccacaatattttaacaaatctatttatcatttttataatatttaacatatacttatcaatatattctacatcaaagcgcggatataatttgtttgttttacgataggtactgataaaccctcatgtttcattattttttttccttttactcctaggtcgattgtcaaaaaaatatattaaaaatacttaataaatcccgtagcaaagtgtgtggaatcacatacttcctccgtttcacaatgtaagtcattctagtatttttcgcatttatattgatgctaatgaacctaaatagatatatatgtctagattcattagcatcaatattaatgtgggaaatgctagaatgacttacattgtgaaacggagggagtagtgtttatcatattcaatgccaggtttgattcttggtgacatagggcatcctaaaatatgtattgtagaattaatattgagtcagaatgtaattaatgattggctaatgttctcggactagcatatactcgtataaagattggtttcatcaggctttcgaactaaaattggggcattaatgaatcggtttctttgatcatattggttgcttgccatactatagaaccactattgaactcctgatatatattgtcagttgagaccacaaaccatatttaccgtgtgcttgcttatttccctacaatgttttttttaacagctaacatccaaagccatgcactgatgtactagtgatcaggccgcggatggatttgatcaaaagaagtactatatcaatttacagtttatagtgcgttacctgcaattagttttttaaaggagatttatatgccatcattttatactacggtgagattcactttgataaattgtttctttgctgcttctgcagggttgcattgcaagtttattcatatgcactagttctaaggaaatacctcataaagaaacaagcgatatattgtgtgcaaattgtgcttttctattctgttgtgtcttctgctttgtcttgttacgtaattatcgttgcaccatgatataaataatctaataaaactagaggcgcacaataggcacccccggcttataaaaacatatggatttcatatttctatggagaaggatagagtccaaaagtctcagcacggaaacgtataattagttccttttcttttgtaatcaaatttattaaaagtttcaattaatatgcaaattcttaattctatgatcacacgacaactaatttaaaaagtcaataataaataaataaatataaatactccacccaaacattgttagatgttgctaaccaatttagaaagaaaataagccaaagtatttaaccggtgatagtaaaatagaaaaaaataaatatatgatgtttattacatccagctcgtatcaggagtggattggttttgccatcactcttacccgactctgcctaaccgtcagccccgtcctgttccctaacaaatccaccacacccgttcgcgtgacgcaagcggacagcacgcgcgacctctcactgctacgtgggcccttatccaagccacgtcaccctgatctatctaaacccaccttttttttttcctctgaagtaattaaccacggtaaataaattggtcgaaacgggtaattaacgcaatgtgtgggagggaagagtgccccatataaaa

SEQ ID NO: 109471 - DNA, 677 bp, Oryza sativa
gggcaggatagagagcggagcgagaggaggaaggggaatggtggcggctacggtttgcggaagggggttagggtttttttttctatttcacacatacacgccctcatcttatacttttcagagacgcggacaacttttccaattcttctcttcattccgatataatattctattgttcacataggtcctctaagtaaaaacacatagcgttaaaactacgggattgggacctacaacacattatgaattgaatcagggactttctttcaaaatggccatcaaccacgcggaggctggagcgctcgcgaaatccgtcctctttactgggtacacgcctacgcaaaactcttaggaccgagcagcctggggtaggttttactactttcgatttacatctacattctattaaatgagtgcgaaataaaaggggttcaactaaggccccgtttaacgttgcaaaaactaatgcattattttattttggggacacgatatttagcggcatactttaaacacatgaattaatgatttaacggctgatgtctcgatgtcttctaaatgcacactattagataatcagatgaaacatttactgctatcagctaaaactaacttgatataatccttataagccgatgaaacgtccatataacccatcagctactacctcgatgaaa

SEQ ID NO: 109472 - DNA, 1063 bp, Oryza sativa
gataaactcaaaaacgagttcgattcggataaaatactcaacggtttgctccgattcttggggggaaagatagaggagaacgagaggatcaaaaccgctcaaaaatccggactcggggtggcgggattgggtgcgggatcggcgcggcaaggcggcgcggcgaccgactcgggctctgcctgagttggaagatgaacagtagcgcagggaggaaaagtagacttttccggctgggctgagaggagaggaggcggctcaggttgggccggcggaagagagaggaaggaaaggaaggaatgggccgaaaatggcccaagctgaggaggaggattttattactttcccaattaaaataatcacttaaatgatctttgaattgttaaaaatacttcctatgctcaaataattccaaaaaaaaatcttgaaaatacttggacactcaaagtacttaacaaaattataattagaccatttaatgattaatttaatatgtgggtaattactgaaatgctctttgtatgattaaaattaggaattgagctccgaaaaatccgagaatattccagagagtataattaaccatggagaatttaataaaaattaaatccatccatgctttatatttaggaaattttatttcccacatttaacttcacttgtaaattaatgaacatttaatataaattctgataataatttattaaataattttataaatcctgaaacaaaaatcaggatgtgacaccggtacgccgatcgacgtcgcagcgttgtcctctcctccagctgctcctctgtttcgccggaacgccgtcgcccgtgctggcctctccatcctcatcgtcgccgacgtcccttcggccgcccgttcatcctcaccggctcgtcgtttcacggcgccgcctccgtcatcgtcatcgcagcggcgtgttccacaccgtcctcgtctccgtgcagctgctgctggctgtcccttgtcgcctcctcgccggccaccgtcgtcgttgtcgtcgtcctcttgtcgttcccgttcgtcgtggtcgttcccacgcctcatcgcgtg

SEQ ID NO: 109473 - DNA, 1017 bp, Oryza sativa
tgtgatggttggaatggtcggtaataccctccaaccgtcattggggatcaaatccaaccgtccatccaaaccgtgcatccatcggcgccatgggaggttcggccgaaccatgggctggcccaacccaacccatcttcgactggcggcctcctttgttgtcctccttcatagacttgtgaattttggcccaatgtgtcgtgttatttctgagttcttggcccattcatacataagtctggttctcgacaccgtccaattgatttatcgtccgagttgatgtcgattctcctccactttattgtcattcgctgcaaaaggttagtatacctaatactagtggaatattattattgtaacaaatatattgtcggatcccaaaactaatgattcggaaaccgacatgtttaactgtatcaagccctggatcagtagattgatacagcttcaacaatctggattttcattgcgtacatttgaacaaggctccaaaggagatgttattacataaattaataggggaatttacaagattgtggctaactattacagcagaagctatagagtgtctcaactctaatattttgctatagacttaaaccatctaactaatctagatttgtgaactaggttgaaataagactaacttatatgattgaactcctggctttggcaagaacttcaatttaactctggaaaaaggaggttgaagcaagggtgagtacaacgtactcagcaagctattatattcaataatgaatgtataaaaaggtaatatttgagtaggattacgattacttgcagaaggcagagagtatagaaatagaaagcctgatgttttaaatgcagcagcatttagtaaaatcttgaattaggtttctaaccaaagtaccatatgagtcccgatactcaattccgtgagcacggctattcgaatagattcaggtttactttactgcagtaaatgtacgctttacccgcaatccatgacatgccaatattcattagcttagtcatggc

SEQ ID NO: 109474 - DNA, 1408 bp, Oryza sativa
ccccaattaattttggaatccaacgcttgaatcgcgcggattcgagagagcaagaaactagggttcacgggagagagagaagagctgtgcgggaggaggaagaagcgcctggcaggcgggtcccacgcggggcgcgcggtcagtgcacgtgcggcgctcgtgcgcacgcggctacgacaggagggcgctgcgactcgggcaagggcgcggcttgggccgggcggctgggccgaggcaggccaggaggaaggaggaggagggagtgggctgcccgggaggaaagagagaaaaacaaagggaggggagagggacttggactgcgggccgagggggagagagggagactttgggccagacttggcccaaaggaaaaggaggattatttttaggttttctttttaataaactttgattattgtttttgttgcttaataattatttccggtgctctgaaaattcaagcaaaatttgagggctccttttagaccaaagagaatttaacaaaaattctccgggccacattcgaatttttcttgtacgtattttagtgtttgccaatttcttttcgaattttaattaattctattattccttttagagaatgatttttatttttgggatgaatttatcaggacgtgacaaatccaccccccttacaagaatctcgtccccgagattcgaggaggctagcaagaagataggttgggcggtcttctcttcttgtctggcttcttccgtcgcgtcttttataacaaacttgcctagcaaaacttctccactctggactgctgggctcgatctcctattgcaaatggaatcttctcttcacctgacttgtccctggttgaacctttagctgacttcgactgggttgcgacacttgaagatggtgcttcagttccagaacttcgcatagttcatatttttggagtcaacctcatacaagttacccacttcatgtcatgcgtcgagatcagctcgtcattactaggataccatgcttgtcatttacttctaacttgccaccaactgcctcatattagctttcctgctctccgggtgatagctacttctgctatttgatgcaagggtcgataactttgcctttgaattatgcttcccaagagaaccaacttatcccacttgatatactttgacgtcttcccaaatggctttactgctggatttgttattgtctaatcattatcctgccaatttgaggcttcgttgttagatgcgattttaatctgacctctgtagattatcttcgaacatatcacttggttcataactgggaatagctctcacgaacaagcaactcggattcacttcctttacatttggttcacttcccactattctcttcatgttgtcatcatttagcattcaacatattcctttgcacctt

SEQ ID NO: 109475 - DNA, 1002 bp, Oryza sativa
tcaaaatgagaaaagaaaatgccgagtccgggaagatatctgttgcttcaattgtcaaggaatgggtcatttcgccgacaagtgcccaaaaccgagaaacacagctgccagcacgtcagtccacgcaactccctgcaatcagaagcttgctcctcagcgaattgtcatccatgcatcccgaagcagtcctatagcccgcgttgcaacagctccaactccagcgagtgcattaccacaaggtgtcaatgctcaatttcagccccagccatcagttgacaagacagaggccactatcggcactgtacctttggatgttccagcacagcagccaagaaatcaagtacaggatgaagaacccaagcgtaagaaagttatttacaacggtagtacctgttaaggaagcagacgtgccaatcgccaagtggtcactggagcaaatgcagtacctgttaagcctagcgctagtcagaagcaaccataatactcttatatcagtaatcatatacttatgttttatagttgttccccgtcaatcatgtaataacagagaaacatgagattatgaaggagtttgataagtttatgaaggatccatgttaagattgcaagtgcggtgagttgtgtacactttgttgctgattagggagacccagggtctcatttccgtaagctcataatctattatgaatcaaataacctcgcgattgatggcgaagaaaatcaagtgatcaaccaaagagacatttgtttggactaagagtttcagatgtgtcttcttcggatcaaaggcaggcaccggttgtggagaaattggacacgttgctagcatgtgtctcacactcggcactcactatgaggaagaccatccaccaggggagtgtcccacctgcaaggtcacatgttttctgtgggaaggtacaaaccatgggcccaacgatgcccaactcagtggcttgtggaccaagaccgcagaaatccaacgaacaaccctacgatgtgtct

SEQ ID NO: 109476 - DNA, 2757 bp, Oryza sativa
aaatagggctgaacatatgtcaaaactagcaaatgtgtgtgctaattagtatgctcaattaattttgtttatcactatgcctgtatcactactagcagggcttgaagccaagaagcgtgaccaaagcaagtgctttgtttaatttatggtgaattatgcaaaatttatgtgtgtatccgtgatttgtatccgctcgtagaggaccgaacctgagaacgagaatctcgcctgggcttgtatccgctaacgggaccaaatcagagggtatggtaggatgacatgaatagagtttgcatggaaaccactcctaggcccgtactcatttggccggaccataggaaaaagtgtgaaatcatgttaaaagccatcaaatgaaacgaatttccttgtctcatacgcgctggctgagacgaaggactcaacaaagagaaaaaattcctttggcttgtactcatgatggccaagcctaggagcatggcaagaacataatcccttggttcgtactcattggccgaaccgaaggacacagccaaagaatctattaacatgagtagagaaagacgaactgagagatttttcgactcgtacacaatggccgagcctaaaaatgaagggagagcatgattcccaccttgaaacacctctgattcttctggcacagcagagcgaggaagcagaggctgacgagatggcgtaggagcagagcggcacggcagcgtatattgcctagcaacaagcagcgcttctgcaaagcatacgcacagcacctagcctctacgctaatctcccctgtaacctctccccagcgaactcttctccctgcttgccccactccctctatttatagaggaggatccctgccattttcaagcagccgcgcgcgcccttagcatttgaaaacatttgaatggagcatgcagatcaactgatcgtgagacaatgggttaactaactgattactacatgaagcttcctttatttggatgacgtgtgggccctttcagttatttgctgagtgcatgcatggttagtggtcatcgtggggcaatgtattaactgtttgagtactccaggaagcttcctttatttggatgacatgtgggcccttttcagtttattgggacgaacatgctgttatttgccaaatgcatgcatggttagtggtgatcgtggggcttgaccacgttttcctttgctttcactgacatgtgtctctttcttttggtttcaaactggtggtggattctcttctgcatcatgcctaggctattttttaatccatggaaaacaatcatttttggattccttgatatctctgtttaattgggcatctcaatttatttatttatttactttaatacacgctttgggtatgagttctttttaaagagacacgcgtatatattttagtcaccatttttatcgagcgggctgttattgccgtaaatttattttatgcgacacgcgtcgcgtcctgacgcgcatattatcacggtggcttcctccagcccatgtctagctatcgagataaaaatgctggactaatggcaaatgcaaccctctttagtttggcatgcgcgtgtatatatatccacgccattatagcggcgtgcacgtggcatgcatttttattttaagtcgcgactatttggggcacgatttttcactagccagataaacatctattttggcttacattttaatttttgtatgctattttatatggtgggcatgccttttctgaaaatattcggggcgtgactatttcgggtcagtgagaaaatcccacttaatggccatatgtttcaggccaaatttcgtatgcggatacaacgagaaagctaagtattagcgttcgccggtccgacgaaaagcgcatggaaaatatttgttcacgctacatatgtggaacgcgcatatgcattcctattttaagccaaaaattattttgtccaatataagtgaattacattttatttcatggccatttatttcgtggccgctatttaattaaattacttcaccatctgtctctcgataaaattcttattatatatattttgtacgcactatatttgagataatacatcagtttataatttaacaaattatatttaggacacgagccaaaatccgtgtaaacactaggaaaagaattggtggccaaccggaaccactagggttcagccgaaccagggcggcgcccaatcagcctcgattttgaacttcagtctccccctctcgtctttaatccgttgtgatgcgcattcgaaggtagatcagtcgtatcattccagaatacatattcttccttttctcccccacttttgcaagcttcctctccatcttatcttaattcccttgctccatcacctccaattcaccaatagctggcaaatctttgatcccattcatcggctcttcctccaactccacatacaaccttgacggagagccgacaccggcgaatcaattgatcccggtggaacactacaccatggaaagggtgaatgcactgtgggcgcagccccttgcgacagtgccgggctcccctgcgaatctggagcccgttggcgagctccctggttcggcagaaccaggggttcggccgaacccccattggctccgttcggcagtgcgatccctctcccctcaccatgttacgaagaccaaaatccgaggggattcgcctgtgtgacggacgacaacgggcgagctcggtcttttaaaggcgtgacgccttttccaagatgatga

SEQ ID NO: 109477 - DNA, 954 bp, Oryza sativa
aaatacatttatggtattgaagtactttccgagtatatgagtacctactttacattatgttcatgttatactgaatatacggctagcttatctgggagatgctttggtgctggtatagtgtttgcttatgcaattactctatgtcatgacgatgatattagagtagtatctagtagtttagacgtggtgtctagattacgggatatcattatttggggttctatattacggatgagaggtgggccgctgatggtgacagctcagtacgggtattcctccgtgtcagtacataatcctaagttaattccctggggagggtattcctccgtatttagccctggttgtatggtcatgacgggctgtcgtaaggaactcggcagtcaggggtggcttctcgaagtacaaggagggcatcggatatagggtattagctagtatatcggttaactagaatgtatgtatactatgtatatcagaagtattggaatagattttctttctcttttctttccacttagcttaaatgatatattatgagaatgagtagttaatgcttgtgtatcactctacccatggattatcttaaccccagcttacaatatgattatcacaagtaatatataaattattagtcaagttctctgtacatggtcttcccacgggataaaacaaatacaatacccttggaatactctcgggtaaaatgctacaatggtatacccgtgcgctagcggatgaattctgtaaccataatataccagaagtatttctgtgctattgctgggaattattttatatttgcctctgtataatcattttcctttgcaggctaaccttggttgttttcacttatgttgtgaaaacagggtagtgcatgactggtttcaacttgccgaaaaacttcaaataaaatccagaagctttcttccagagcgtcaggccgcgagtcgctgc

SEQ ID NO: 109478 - DNA, 599 bp, Oryza sativa
attcctgcagcccatatgaacggaaatagagaaactgaatcacaaaatcacaaatacacaacaatgaatcaaatatccaaaaaactaaatccgaagaactaaatcaccggtgtcactgctcatcggaggccaagcacgcccatgccctgaggctgtggcggcttggcaggcgcaccgccacgtgccgcgaggagggtgctgccacagagccacttctagagaagaggatgatgccaccgagaatagggcgtcgcccgccagggaaggagctccgctagggaaggcgccgtgcgagggcgccatgagtcgtggcagcgggggagggggagcaggagcagtggcgctgccggcaggggtgggacagtgtgacgggaaaagttgccggtgggaaggagctccgctggccgtggggagggcgccgcggctgaggtgccggctgcaaaggttagtgcgccgctcgccggggaaggcgtcatgcgagggcaccgtgggccgttgcgaagggggagagggagtgggagcggcggcgctgctagtgtgggtggaggaggtggaggggaaaagtccccgccgggaaaggtggaaggggccgggggggg

SEQ ID NO: 109479 - DNA, 567 bp, Oryza sativa
cggggcggcgggaggaaggagatgacgggtgggccccacacgtcagcggcgcgcgcgcagggaggaggccgagtgggccgcggggaggaggagagagggggagggagatgggccgaattcggcccattagagagaaggagggattttagggtttttctttttataaaatcattttaactttgtttatttcttaataattattatttgtgctctgaaaattccactaaaatttatttacacattttaggcttttaggaaatatacaaaaatcctccaagccctatttgacttttaactttgcacattttaatttttgaaggctttcacaggcattttaattattctaggcataatttagaggatgtattttagggtcaatttgggacgcgacaaacctaccccccttaaacggaatctcgaccccgagattcggaagaactggcgaagagatctggatgggctgccttcagctcatcttcacgctccccagtagcttcttcctcgtcggggttgctccattggaccttgcaaaaaccgattaccccgattctggtcctgcgcttcatg

SEQ ID NO: 109480 - DNA, 840 bp, Oryza sativa
caataatccccttttccttttcaaaaataattcattattgcgttataattcaattaaaatccatataaatgatttaatccgatttaatatttgaaaattcataactaattaatcttagctcggatttagttcgttcaagtctctaaatttttctaaaattgagatctacatgttaaaaatatccacgtgtattgtttatgcttgtttatgtgctgttttggtgattttgttcttttctctttagattccgacgttcccggagagtccgaatttgtaggagaagactttgaagagttccaaggccagcaaggcaagtcacacagatcccaaacaaccctttgagcatgttggtcccgtttaaagctattgtttctattcaactattgcatttattttcgaatgtcattgggtggaattaacctattgttttgttatagccctttttgttcttgattactctattccttgataccttgggttattataacttgactagttgagctttatatatgggttcagctggatattagatataattgcttagccatgcttagaaacattagcacatagttgggataacttatgcttcactattatttaatgatggcttaatgatagctcatgatggttaatcatgattggttaattaattaatttgccaactaaaacctgataatggtgggttgtgagcatatggttttgatggttgtgctcatgacaattaaggaccggttcacgattttcggttgtgaaacatttcccgtgccaaccacaagccagcgtgggcaacgactttactttctgtatagtatggttcatagtagagcgggctgcaggaat

SEQ ID NO: 109481 - DNA, 651 bp, Oryza sativa
acacaaacgataccacaagttagcaccacaaacaactcaggcacataatgatatatgaaagcaatctcaaacgaaacaagtaaatttcttttttcccttcttttttttgggtacagcttttctttctttgttttatgcacctttctgccttttttttctcttcttttttttgattttttaaaaaaaaccaactcaagggcctcaatgcaagattaaagggactcaaatgtaaatataaaaattatagggactcaactgtaaaagtccaaacccaaaattagatatacaaaaataaaatgctcatagattctgtatttgcaaacagatctccaatccgatactaaaattttttcatcaagctatatgggcaactcacagtatggattgaaaccgtgaggagaggagaccgtggatctaggaggtctcggacacgactcactaggtggagattgactcccgtcgaccttaggatcgaaaggccccacgtaaaaacagaaatagatctctcccttcctttttctcttctctgtgttggccaccaaacggaaaccaaaccaatctacacactaattcaggatcttttgctgaaaagaggctaggccacgtcattagataaaaaaggaaccgttggatgataactgtggcagatta

SEQ ID NO: 109482 - DNA, 1358 bp, Oryza sativa
attcctgcagccctgaggttattgaaaggctatgccgtggcaagtctcattcgttgggacataggctcatgtgttgcgcaagtcgcggagtacgggtaaagtgtacatccactgcagtgtgagtaaaaccaatctattcgaatagccgtgctcgtggatattgagcatcgggacatgtattacacttggctagactctaaattcttaaattgagtgggatgggatatgcatgatgattttgtactggcggatcatcctctcgagagacgagaaggagtaaaccccagaaaaccattacggccagtaacgggaagccatctttgggaagacaatagatggtgaacagaaccgttgctgtgtaataaatactggaattaaaactggattagtctatgctagataataagcttgtgaaaggaattgtgaaactagctttatgcaaataaaccaatggccatactttgaatatcactatcatatgcattgttgttatgatggcttgctgagtacggttggtactcactcttgctattacaaaatttaatcagtggatggcaatgaagtcgaggaggatccctatgcttatctttaggaggatgcggaggataacggcgctccgtaggtcttagttacggccgttgcctgtggccatggcattgccgctacctataatatgctgccttatctatttctgttattgtttgtattgtggaccgtttagtcctatgatctaagactgcctgcgggcctatgatgtaataattcgcgctagacaatctttgtatgcgcacttgatatttcggcaatgtaatcgtgagtaccagactacttgatccagggaaatggtactattaacaagagtgattcctgttataaaaacgggggtctacagctagaggcagctagcggcgaccggagcggcagcggcggcggagaggaaggcgatggcgctagggcgatagagggcacgggagagtttggcgaaatggggaaaaagagagagggcagagtggggatgcttaaataggggagatggagctcggacgtggccgggagaggcgggaatcgccggccgatgtgggggaagtgggagaggagagagaggcgtgattcaaaaatctaatcccggccgtctcgagcgcgggcgcgggcgggagagagggggaattgggcgcggggaacgctggcgcgagggcgacgtgggcgacgtggtccgggaggcgcaggagcagggcgcggcggcggttgcggggcgcggtggcgccggctggaggaaggggacgagcccgacaggagggccccacctgtcggtgaccccgggagagggaggccggcggccggctcagctcggctgggcc

SEQ ID NO: 109483 - DNA, 1753 bp, Oryza sativa
ctgatgatcttcttgagtccgtatttttggctttgtaatatatatgatgcaggtatgtcacaatttgtccctaccgagctccacatatcagccttagaatagggataaattctggtacattttgccttggtgaggatccaaaaagaaaatatacatccttgagagataagagagaaagtcaatacgaggaaaagagctagtttgcgaaaattcataaaaatcccatgagtctggcacagaagcaagagggaatcgaatcgagatcgttccatttatcaattgctcaagatggtaagatagccattgataaagttcacaggtacatgtatggttgtaaatgattttatatgcctgattcatatcttgaagaaattcattctacactaacctttactcagggatgagcaaagaactaagtgtggggggttttgttggcggctgttaaattttgattctataccgccaacatctgcataaaagtccagataataaaacatccaacatagtgataggtgcttaatctcacatattccacaagtgttggtgtatatttgtatgcaggtgataaaccccgaagttgggaggaaatctagactaaagtgaggagaatcttgtatcaacacaaggatgggttgtgaacttcatcaaaataccagagaatcagcccaaaataccgaggaatggatagaggaggatcaggggaggacatgggccaaaggccaggcctggggggcatggcccaagttcggcagaaccctggtgatcaccgttgatctcaggttttggcatggacattcgagatcactccttgatggcggttgcggggcagttcggacatttccccttcgctaaccgtcatacctacctctatataaagacttcactttactcacttcgacacacacttccaagcttgagctgaattataagaggctctattgtactatattgcatactagaataggaagagagtagagtagaagaagtcggaagaattctggagttgtcgataatcttctctcatttatttattctgttaattactctgaattcaatataatattcttcctgagtaatttagatttatctcgtgagaattatttcttggttagtgcctaaatagcatacgggatcattgatcactatagtttatttatttatagtggttgctttagtgtttgatcggcactagagtagttattaattgcgtagacgcggtgtctgggtaattaatctacagtggttgctgcgcatcccacagtacgtttgaggtaggtgtagaggtggtgacagcactcaagagcacttaagtcctccctgtccgggtacgtagtagagcgacatctaggaagagcgggtggccagtgcccgaagtattgcgttaggattaaaattaagctttccgtagacactgtttagtgtctttggataaaccggaggaagatctgaccacacacgttcccttggattcaatacccttcgaatactctgtaggggaagtgctacatcggtatatccgtgcgcttgcggatcttatctgtgatcgtaagaaataccaacaatgatctaagccctttaagaaaatattttcttcacataggttgttcgaaaatagattttttttcttatctacatgctttaacacactaagattttctggaagaattttctctcgtattggatgtaacatccattatctacatgttttcacttgcccatcgtcattttgccacattgactgcgatcgagaagt

SEQ ID NO: 109484 - DNA, 634 bp, Oryza sativa
atgactatgaggattttcaggagttggttgacaaagcaattcgactggaagacaagaagaacaggatggacaatcgtaagagaggaaggattgttttccaggaggcacaaggtagtagccagaggcagcgtatcaagccactccaaattggtgaatctttttctgcaggtcaagaacagtcacaacagttgggcatcagtggtgagatcaactcagagactaatgcaagcaatgaagacaacgatgagcaagctactcaatcagtgtcatttcagcaggatcagtctcaagaagataacagtaatggaagggagcagcgggtgtgtttcaattgttatgagccaggtcacttcgtaaaagagtgtccgaagccgaagcgtcaacagccacaaggccaagtcaacaaccttgtccttacagaagcaaatgcagtgccggttgcgtctcaagggatacagctcagccaccagtttcaaagcggcattagttttctttaaagccttagaataattatcggagttatggaataagatagactgcagtttacctatgcctttttctttctagccgttccgaatctcgggacgagattctttgtaagggaggtagatttgtcacatcctgatttttgttt

SEQ ID NO: 109485 - DNA, 1035 bp, Oryza sativa
ccttggtctaatggcttgcacaaaagaacacatcccctatttatattcccactgcaaaatacattgggcaaaatatgtgagcattagtcttgcttgatcagggacaggagtatacgccttggcatgccaggtgcaaaagaccgctttggtggggtgatattatatggagccctcaagtcctaaagggcaaaatgtaatgtacagtcagtttttctataacaaatgagcacacaggtaatatatagttggctaacaacgtttacttacattttgggggctgcgggggcagtttgtctacgaacagcgcacgcacaactgatgctttctgacaatcatgttcacgaggagatgaactacagatgcaatttgtttgagccatgagaaaactcaaagaaaaaaaataaggaacgtaaatatgaaactgtgcattgtcacttacccttcctgagcaagatcctcatcaattacagaagatttatgttttttgtctggttgtgccatagccaggacctgataaagcattagtggtcagttaggtttgataagggacagacatacatatttgctctaagtacagaatatagtgctagcctctgaagtaggcggtgttgtcccatgctgatcatcacggctatcagttgtggcctatgcataagcaatattaatataagaatttacaattgtttatatgcaagagagtacacattgctgcagaatgaagctattagattatacctttggatctggaagcaccagtggtgtagaaggtgtcatagattggagagaagagccaattatcgtgtgcggttcaattgcatcagctggtgatgagccatgttgagaagatgccacagaagcatcatggctgggcagagtacttgtgtgggctgcatctagtgaggctagcataagggaatccacttggtaagatatccgatttctttgcaatgagccacgtgacacactagttctaatgacatattgttttccaaaaactgctttgatttctgatggaactatatctcgtgctccttg

SEQ ID NO: 109486 - DNA, 530 bp, Oryza sativa
aattcctgcagcccgtatggaggaacctgcacaaggtatgtgtattagtgtatttgtatatgctccgattaatcttggggacctaggtatactcttataaatttgtggtgctagttttgttcggtctcttgcatcttgtttggtctgaaggagctgtgtatgaggggcttgtttttttagatgtgtgattatttttcagttgacccgtgttgatctggatctttatagcagcatatggtgatttggatgatatatatataaatggatgattataggaagttttaggaataagggaagaaaggggatggttttatgatgtcggtatggttagtgatgttgtttttgttatggtttaacagagcagcgtcggctcatgcagatcaggtccaaaacgttgctatctgaggttttgagaggcataggcgcaaatgaggcacgatacagttgccgtgctgtagcagatggctatgttgggtttgctgaggcaactgtttatggtgcaagaggacctggagagccttttgttgttc

SEQ ID NO: 109487 - DNA, 704 bp, Oryza sativa
aattcctgcagcccgctgtcgatttccccattgcgatgccgacattgttccatccatgcgtgtgctcagtgtattttttttctctgccttccaggttgcgggctccaattggcgtctctcccacacatcgcatcttcttttggggggagggaggggggcatctttgccttcgtcagctaatgctcgctaaggtatttagtacaagatcacattgttttatcactgggatagctgttgagttcattacatatgtgtggagctgtggtatatggataaactgagatgattatgtcagcgaatacctgtttgcttgatttcgcatatatggtgctcctctgtttttttcccttggattgctaattagctgtgctttggcatatatttacattatttcatttttctattgtcctgctatgttatatattctttcgtaggttggtttttttatcgcttatgtgggatacatgtttagttcatttcacatatgcgatgctgcgatatgtataacccgagatgcttttgtctccagtatagctgttcggtggatttcgtatatatggtgctcctcttttttccctccttcagttaccaattgctttgttttacattgttccgctatgatatatattcgctcctctttttttccctccttcaattactgattactttgttttacattgttccgctgtgatatatattcttgg

SEQ ID NO: 109488 - DNA, 653 bp, Oryza sativa
tcttttagtaataaacataataatagttttgcacaattgccttgggatgtttattaacaatgcatagaccttagtcaactttctggtatacccttcagtcagctgacagtgattatgtaaactgggcattatttacgggcactcgagctatcaggctttgcccgtccatggtgaagccatttttccattataatcattatcagctattacatactcgcctcccatataaatggaactttgaaacaaaatatggttgctctcatctttcactctttcataccacaatacatcctcgttctaatcatctgaagttttcagtacaggttctaggacatttcacatacagcttggtattaattagtatctaacttgaggattgctagcaaatggaagcacaataaatgtatgagcatctacgggcaaaagtgggatgcttgtgttctttaaaggaaagaagttgctgactgacagattgttcgcgacagcctcatccaggagctcttgtgtaaccttattagaagtattcgttgatcgctgtagctgacccctctcgttgtacataaatgtttttttgcgaacggggcagcccttttcgttcttgttgttcctatatagatgtagaacccatattatggtatcgtgtatttgctaca

SEQ ID NO: 109489 - DNA, 601 bp, Oryza sativa
atcaaattcccctcgctgaaattatttagcagcctagcaggctaatcaacaaaaagaaattatatatgtaccctgaattgctgctggtagctggtattcagccatgcctcaccaacgattatagcttctttctgtttttattcttagcacagaaggtgtgccgtcgtttgtgcacttcccttttctattgagccatgatattgactgtatttcttctgtctcataaaaaacaaatctaagatagaatatgactatcttaatactacaaatctaaacagctcctaaaactatgaatttgaatctgattgtctagattcgtaataatagaatatgttccatcatatctaggtttatttttaagagtacatttattaaattcccatgttttaggtgtaattgtgattttacccctacttaagtagactttacaattttacccttaattttctcgaactgaataatctgtttacccctggtttagatgtccagtcccacataaagtgagttcaagaaattagaaaattgactaagaaaatatgtaaatactctactaaccctcacctattcaaacaaatccactgcccccactctaaatcccctc

SEQ ID NO: 109490 - DNA, 1404 bp, Oryza sativa
atgaggcgtgtgcgtgtttcccccgatgtgcccggcacgacacctcgccccgcgtagagttgacacacgggagggcgcgtcgccgtcgcggatccagcaaaggaagatatggcgcgatccatcggcggcaagggcgggggaggcaacagacgaaaggcgtgccgcgatcgcgatgggacgccatgcgtttttttgtgcgatgggagatgaggacgacgggacaggttacggagcacgggagcagcggcgaatcgtgatccggctgcaatccaacgtcggtggcatactgacatcagaggaagggcggggaagcaacggccagtccagctccagggctccaatcgtgcatgatctgattgacgataggcgtatccgcataggatgcttgctgtttctgtgttctgccgactgacgtcgcatgcgtgaaatagccaaacagggaactatacttgcaacagaaagagaggtgcatgtagctgcgccacatctacctatttggaactcatcccttattactactcactactacaaaatctatttttcatggcatcactttatttttttttctttggcggttatacgcagaaaccgccagaaaaaaattaggggggggggctatgggccaccagcgaaaatgaatcttcgctagcagctcacttagataaccaccagcaattttcgccagcgggtgcttaggagcaccatctgagaaaataaattcgagatataaatcctatccacctctctccgcgctttcgtggcctctcccacccaacccaactttctccgcctctctcccacctttctcgatacctctggcctcccccctctctctccacctttctcgatcttcctccagcctccctcctctctccaccgccgtcggctgccgtcgctttcaccgccgccgcatccgtcctggggaaggcgagagcgaggaggacgaatccgctgcctctcgtggcctctccacccaacccaactttctccgctctcttccacctttctcgatacctccggcatccctcctctctccgcctccgggcctccctcctctctgcaccgccgtcggctgccgtcacttccaccgccgccggttgccttcacttccatcgtcgccacggcatccatcctcgggaacgcgagggcgaggaggagggatccgccgcggcctggctgtggggagcgtgcatccgccgccgtcaggccgcggggaggatggatccgctgccgccagcacgcggggagcacagagctgtcggcggtagctgcggggcctcgtcgtgtcgcggatctcatcgtcacggtcgccgccatcgggccgtggggagcgcggttccgccgcctccggccgtggggcctcgttgtcggttgcgtcgcagatctcgtcgtcatgaccgtcgc

SEQ ID NO: 109491 - DNA, 2066 bp, Oryza sativa
ggcggctggtatagtgtaccgcctatgaaaaatggatcgtgtggtattcaagtttcgcaggcggttagcttacgaaaaccgtcagagaaaatggatctacgctggcggtcagctaccgccggcaaaaatactgtattaccattggcctttagtcactggcggtgctgtcagccaccagcaaaatttcattttggcaaaaaaataatgatttttctagccgtgactgtatttaatttgttccaaaatggtacggcggtgattccaaatttatgatgtgtttagttcacgctaaaattgaaagtttgattgaaattggaacgatgtgacggaaaagttggaagtttatgtgtgtagaaaagttttgatttgatgaaaaagttaaaagtttaaagaaaaagttgggaactaaaccaggccttatagtctatagctatattttgagatgggtagctacgttaatagcttgtcaacaatatatgttagtgtagaatgtcagttagcacttggaagatttgtttataatcttcccagtttaacactatcaatcttccgcgcacagttgttgtgatgatggtcgaaacaagtcggtcgaacaaacgcattccacgtatgatgtaatatagtaactgtgctataaaatacagtcttttattctctctggagaaggtagcataaaattaagtttttctggagggtaacataaattccagttgtttgtggcgctcgctagtcgctatcacagaaataggcaatggctcgtcgagtcgttttccgtcttccatcctgtcttgtcctagaaaggccttcagtccttcacccttcaagccctgcttttgtttccaccaaagtctctaactgggccttcaccaaatactttcgcgaacattgtactacgatggggctatttttctgggtccaccaaagaggaaaatctattgtgtggcctgcgcactacaaaaagggcttgggacacccatgatctgactgggccgggagatctgccttggatctgactgtttgagagtctcttctttctttcgctaaaaaaaggtctcacctttcttagtctcccctgcaagagatgtcatgaccaatatgcaatgaacatactcgagagtaacgcatagtctaatatgattgcaatcaacgatgcactgtattattagagcaagttttatggaggggtgcttgctagcctttagttttgttcacatcatcaactaattaattaagcgatagtatataaaatacattacctctaatacactagctccagtataatataattttttatttgcatccaatttacactggtctctcgagtctcaattttctcccttagagtttgttaagaggttaccttttgtatgaggagtggccttttctcttttttctttgtcctctccttcaattcacctcataatttagtcttagtatatggcatcatgggatctggcttaggtgtccttaatacttaggtggtgtttagtccctcccacccaaacaccaccttactcttatactggcataatgctcgccaggttctgaatgtggtctccaatagatatcttttataataaagtagaataacaccaaagttgaatgtaccttttttggagcgtgtatgtgataagcatatgcttttgtattgtgtttctcaaataataaaataaaataaagcagagtgacgtacattagattggtaaaaccaaacaaacaagtctaacgcgatcgcaattggtttcgtttgctcatgtcaatctatgggtttatgattacgggcatgtttagactattgccaaaacaactttttcataatttagcatacccaaattttttataagagacaacatcgccatgttttgatagggtaaagttaatttggatatgtttagtttggtgcccccatataggataccaaatgttggcaatattcaaaggataccggattttggtatgttactatggtattgccaaattcctgtagtcattgctatttgctaatgtttcttaacaaaccgacctatgttttgtattccactttaaaaaaaatagcatggtttaaa

SEQ ID NO: 109492 - DNA, 2400 bp, Oryza sativa
cattgttttttatataaggtgaaacaacacccgatttaaacgattgaaacattttcgatctacttagtgaaacaattccaaaatacttggtggaacatcgtgcaacatttaaaaataattcaataataagctaaaaaagtttcgccggaatatatctatgtgtgatcttgttttaaagatttaattataacgaatttaatggtgcaatcggattatgatttggacaaataatttaagagaaaaaaatagtttaaagtggttttgcacgtatgcgtcatgctgacgtcaacgtccgatttcccccctccctgtcgggagcccgacgcggagtcgtcttctccacttcatttatcaaatggagctgattttggataggcatgggatatgccggtccaaattttaggtgttagggtgtgcttttagagcaattttaataataatattgccaatcactagttttaaaaattgaaacattatttataaccaatctaatagctcatttatataatagttaattatagatatatactgcatcattaatacctaatatattaatgattaatactgtgtgtaacaagaactctcttccttttaatatattgacgtacaatctttttacgtgccttttatctctcccttcacataagcacaaatataatgtggtacttcctccgttccacagtataaaaccttctaacattatccaaattcatataaatgttaatgaatctagacacatatataaaatatatatattgatcaatggatgaatctagataagtccaaaaagtcttacgatataaaatggagggagtgacttggacaatctgtttacgtcatcttattatactcactcttatatggataagtatataaatgtgtatatgcgtaaatatgtttattgtgtttctaataaaattactaccacattgtttcgattttgaaggggtgggtaggagagaggggaaaaagtttcctcctaaaaaaactagaaagaggaggttgagtcgagggaccgatcgaatatgtttagttccacgctacaattaaaagtttgactaaaattgaaaatttgaagaaaaaaattataagtttatgtgtgtagaaaattttgatgtgataaaaaagttagaagtttgaaaaaaaagttaaaaagggtaccgcatagtgccagatagtacagtagccaccaaaaagcccacatatccgactaggagtacgtttttacttgcttcccccatcggtctccctctggcgcgccgctttggcttttccgaaaggaagccagtcatccatctcccccgatttaacccgacgccgtgccgctagtctgatccgccaccgccacggtctcctcctcgcccccgtgcctccgcctcctcctcctcccgtccagcccgtatcgacgagaccagcaaggcgccgccgcgcgcggagctcttgacgcccgccgacgacccgcccgccgtcagatccgcctgctgcatgcttcctccaggtttagatcgtttccaaaaatcctctgcttctcttcagtaattccacccgcgtacggggtttctcgatcagagcgggggttccgtttatgatcgggtcagggtttacctattccttgtgatttgggcggcatgcgatttttggattataggtgacgtttggaggatatgtaatattatgggttttcaggaaatcgtttggatgctgtagttaccaaccaccgcagcatgcctagcaatttgtgcaattactcgttactcttaacagcactcacgctgtcacgcgcggtgtggcacactgtcaaaatttgagatacgttgacacttcatcattggtggaatctcgtgaaggaattatttcagcggatgtgcatatgctatagtatgagaacatctatggtattatgtagatacaacaatcactaaccagtcacgagaagaaggtttttagttgtgattctataatatatttgagaatcaaaactaactttacaagcttatgtgggtttgacccttcaaaatttcttggagttttttatagttcaacaagcgtcaatgattgcgattcatatatatacattgtttactagtaatggtttgtgtgagttcttgagacaaaaatatgtggttgaccacgcaccaaatgcattgttccaccactgcttttggttgtgatcattttcgcatagatagcgtcatgtcatgctgcattttgatggtgatgttgtgattcgtgaatgcaagcaaaataaacgcaatggaaacattttttttgcaagtcatattttttgtttgtttctagttctcatcgttatcttcttttaataaatgtgtccctttgttctcttagagcattttcccctctcagaaaattggaaacatttaataagcatcagagtgatca

SEQ ID NO: 109493 - DNA, 944 bp, Oryza sativa
  unsure (1)..(944): unsure at all n locations
atgagtttctgcactctttgttggacaaattttagaattacattctttgctcgacggagggtgagttcaagtacattggcaaaaaaaatgattttttttcttctttcctctctatagctatgagttttgtatattaccaattgtctctcttcaccaaattgccagtgtgtttttctcttttatacattggcaattcatttatttcttttctcaagcaaattcatttttcttaatcttttctacattgtcattcatccaaattttgtctcttttgttacttctaaacaaagttgagtttgaactttgatttggtgtgaatgtattttacgcctacaactatttctagtaattttttttcatgaatttagagaacttttaaatccggttttcacgggtattcacatatttgatgttttttcagtgggtattccccattatcaattcaagagacttgtttatcttttgtgacggttgttatcccaatcaaaattttaaaacttccgcatatttttttcctcctaatcagtggttggggcacttagcataatctgacgacaatagatatgctagaagcctagaatcaatgtgccacacagctccgcctaacagatgctccctatggtcacttttacatagcttttaggacataaaattagtgagtgatttaatatgattttgttgtctcaaactttaaatatattgacatgagggagtaggagcatgtggtagatggtgatgctactcaacgtgcaatagtctagctaaaccaaaatgcaacagaaaggagcctcattgaagaaatggctacgaagttattctactannnnnnnnnnnnnnnnnnnnnggatcctctgccgtagatacagtagccataagcccataactgataggttaattcgatccataccattacaaatagggaaaagtctaaattaccccataaa

SEQ ID NO: 109494 - DNA, 1567 bp, Oryza sativa
aattttatgggaaactataaacaaaatagaaaaatagcgtcaagtaaataacaagtcataattgatcccattggatagatcctacctccaccatcacctcagctgaaactagtcggtgttaatcacttaatctccctgtgtacttaaagtcatacccttagcagttaaacacttactgaaccaggacttaacaggagtgccacgtaaacacttactgaaccaggactccacaggagtaccattaattagttgctggtatcaatttctgcaggaatgccccgcaacacaaacacaagcgatgggtaacgattctcgccatgtttgtagagcatacggacatccatatcatggctcaaaagataaggaaatagcacaatcatactatgcctgtggcacgcctttggtgctatggaaaaaaatagtattcctgaacaaagctagaattgacctgtttctcacagagaaaaaatgttgcaagaaatctttcgtgaataaggtgcaaatcaaagcaaaaggcatggctgaatacctactaccaacaataattcagggtgactatcaaatgtctgttagcctgctaagtaatttgactaatttcagtgaggaacatgagtatcaaactaacgcctcggtacaagaaaaaatgatgatgccaaaggacaaatagacaaacaagtagcatgggataaatgatgccagaggcgaagcatacaaatgacatgatccagtattattcagaggagcgctaatacgaattctaagggaacatgatgctgctgatcaagcaggttcattacattgaataggagctcaagagactcaaacaccatacattagataagctaaattcgtgaaaaaataatgttcagtgagagtgactggcactaacgtaagctgactgcatctaaatttcgccgtcccagagctcctcatgggtcttataaacgctgtggggattaacaatgacgtcgcccctgagaagcctaacctgaacatcataaaacaagaacatcagaaataactggtgcactgttatgagttagtagaaggggttcaagataatgagatacttgattgatgccttgatggcaaataaaatagctcatggcataagatgtacaaaattgtcctgataaggccagtggttgcgacataaaaaccaaacaagatcacgtgacaatagatgaatataattatagcacatgtaatgagaaatgagacaggcaacataataaccagagatcaaaggtgaataatagcattgctgagatattacaaattacaatagccttgaacctacatatccatttcattatactgtgtgttgttatattattattattttagataatgggaatttataaaacccggtttctacaccaacgggggtgtatacaaccacaaagtgtgatgttatattcttgacctatataatggatgtttgttgctgcgcacgtgcttccctgaacaggtctaataagggataaaataatgtttctatgagtatcctggtattgacgttccaaaccaagtactccctatgtcccaaaatataagggattttggg

SEQ ID NO: 109495 - DNA, 817 bp, Oryza sativa
acataggttgccatcgtggacagatcccatatagacaactttggaacacaaaagacagcaacataacgcgaaaacaacatagcgggagctaacggcggaaggcgacttaacgactaagcgctaggctaagcgcctaagcgactaacttatttcataggcacggttttggaactaggctcggaaccctaaaaatcttcatagttgacgtgctcctgaagatactcctcggcggaggggtcatctcctccatcttagtcaaatgcttcgtgtcgaggagaaagagtagagagggaaatatgaagagaaagagaggaggggaaatagtcgctgacatgtggggcccatgtgagtcccatgttgattcaactgctacgttggataaaatcggggtcaaaaccatctaaggatctaaagtaattccttttttaagttgagagatattacatagtttggtttttcggttgagcgacgattttgtaattcaacgacaagacaaaggacttttagtgtactttttccactgtctaattacgcccagcaaagcccaacccaaacaaacggcagtcctgcatcaggtaacaggagaattttttcttcagaggcaaatcaatcacagtgaccgagatagcacttgcatatgcgtacctctctgcatacagaacctatcaccaaatttatacagttacacgcacagtattgttttacaaattcgtttttctcaagatacaaagcgtttcgcccttcgacgcacaaatcttccctttggagacctgcacctcgttacagagcataaacagctaaaaaaaaaaagtaaagg

SEQ ID NO: 109496 - DNA, 597 bp, Oryza sativa
ttgataattgctactactgcgacaatctcgcggttcgtttgcgaagaaatataaagagggtgccttgctgtggctgtgcacttctctctccttctttgttttcacccgaaagttgtgattttggtgtggggttttgatgtagagaaattgatgagtaccacgggtattgccagccaaatattaattgcggaatgtggggaatggggaaagggtgttgccttcgacgtggattcgcctgctgcgacacataagcatgcatatattcgtagagtggagcggaattctgctagcattctgtagttacccagttacgttaactactgtagtgctaatgttagagttaaatgatttatatgatgaagtgatgaagtatacttttggcctgccgacttcgtctggggtttaatttacacaaaacttcaataccttgtaaactacacacccaaatatcatgcatgcaaatcacatcctaggggtggtattgcgggtgttttggttgatgtggcatgcaggtgaacgtgggggcctgatgatttagggaaagaaaattatgtgggcctttttctctttcctagatggggtgtgagtatgggtggg

SEQ ID NO: 109497 - DNA, 553 bp, Oryza sativa
cagtttttaagaatgcaatatcatctaaagctggttattgaatggagtaaatgcttatatgtaatatgttggtagctcgaacatcctggaccattggaccatcgtgattttaaacaccgtacgaaaaaaaaacaaaaggcataagggagagggcgtgtttagtacacgctaaaattggaagtttgattgaaattgaaatgatatgatggaaaatttggaaatttgtgtgtgtatgaaagttttgatgtggtagaaaagttgaaagtttgaagaaaaaattgagaactaaaccaggcctatatacggacacacatgtacacactcatctctataaacatgcacacacgttctacgcatatgagcatctctaaaaattggaccaacatatttaaaaaatgattgaaattaacagagttacctctcatccctatagacgcacgtacgtacaccttaccttacccgtacaggaagacggttgggatatcttaaggctgaagaagtaaccatacctgtctctctactgatgtatacatgaacattcgtgctaagccta

SEQ ID NO: 109498 - DNA, 582 bp, Oryza sativa
tgttacaccatgtagtatccaattcttacttaggatggttttttttggatggagggggtagtggaagtagacgagctactatgtatctagctagggaaaaagaaggaataagttaggggacgaaagatgtagaaggcaacgacaacgatgtggttggtcggaagaagtgaggaggggtaaggattagaattataaagggtagcacagatcttggagtaatctcaaccgttaaaacaagtggctacattttttaagaaaatcaggtgatcaataaacaacaagaagccccttagaatccagtatgagaatttactatttatcattcttccaaatatacatgtctaaataacactctcttaaaattttattctcatttaccatcgactcgagtggcgaatgagaatgaaaatagtaaattcggcattgcaaggaatgccaatggacgggtggagtcattattttcagctgctgcccagcctacggttccagcttccaacagctcgagaagagtgaagagatggcaacacagacacaggaaacggtcgcgcgcgccacagcgacagcgatagagccgctccgcgt

SEQ ID NO: 109499 - DNA, 668 bp, Oryza sativa
aaaatatggcgccataaatatagctacacccctgaaaaattgatatgcacgctgttctctctcgttctctctcaattgaaactaaaataaaaataaaatacaaaattacagtcctatataactaaaattacatttgtaaattcagttgatatgacatgtaagtgcactgtaattttgataacaatgttgtgtaagtaaatatttatttgttatttttttaatatataaaattacaatcctatataactaaaattacatttgtaaattcagttgatatggcatgtaagtgcattgtaattttgataaaagtattgtgtaactaaatatgcatttttattttcttttgtagtccgttggatgtaaatttaagggtagaacaaatctgggtgatttttttttagaaatcacccgacaaatagatagacaatccccatactcaaagaaatacttatgattttattgatacactaatttcagttttttttaaccaaagggctttactaaattcaattctatttgacttgtactagtatgtgcatcgtttcttttatgttcagctatcatgtaccatccacgtcaaattgtagacctcaaagactcaaacgtccttgtagtaaaaggaacgaatacgatgagcttgtaaacattataattcagatgccagatgg

SEQ ID NO: 109500 - DNA, 584 bp, Oryza sativa
tgcgtgcatgattccttgtcccaggaggcaaggtacgccaaaagttgatacaattcagagtttaacaagcggaagcgtaattaattaatttattacatgggcgacgaagacccagcacacaagaagacaaacgaaaaacagcggaagactagggcgacgaccacaagcgcttgacggcaggcacgagctagacaccaaagccttcattatccaggggctcctcttctgggtttgggaaaaattgagcaagactgagtacaaccaccgtactcaacaagacacacccacaagtgcagaataaatgcaagggagtacaagggagccataatatagggggttagggtttgcagtaaacagcattaaaagtcacttagttgcttaaagctactttgtaaacacggtcctagagctatacaatattattaactaaggccgtgaacccacacgaacctgccttaacccaagcgctacgatgattcagaccgaactggcaacccgaccctgggtcccagcttgtcccaagccaacccaggccaaccattccacattttagctgttaggcaggttttaagaattaaaacact

SEQ ID NO: 109501 - DNA, 624 bp, Oryza sativa
ggcagcgggggtgtcactgacacggcagggaggagggccggcgagcaggcgcagctggtggctggcgggggaagagcgcggtggtggctcccagccgaccgactctcgagctcctgattcacgggctcagcgacgccgccgccgcagagctcatctacgccggcagccactcttccccaatgccgcgctgtcgccgcacagccttcgagcttcctccactctctctctctctctccactgtcaccgccgccagcattcttgggagccacccgccgccgaccgcactcgaatctccagtgccaccgcatcttgggccacctccgtcgccgtcgaggtcgcccatagccattggagtcgtgcgccctcctctggccttcctccctgtgcgcaggaaagagaggaagaagagagaaagagggatctaacatgcgggtcctaccttttattattttattatttccccagaaactgccacgtaagccccacgtcaatctcacgtgggatgaagaactagtaaaagaagctacgtaggtgtcacgtcaatcaaaactggggacaataccaccggaggacctcatttgcactgtttttgaaagttgatggatgagttgtaactgggttttt

SEQ ID NO: 109502 - DNA, 735 bp, Oryza sativa
agtattccttgaactttataccattgaactctacttggacgtataaatatttttatggattgtttgattcgactccaaaacttgccctaccgaatcattgataactacaaaggtaataactcttatgtatttggattgcaaccaaacatgtgccaaataaatatagtcgaggaatcttatcctacaaaaacgagagtaccgattcctgcctcgtgcaagaaatttgaacattccaacagggataatggcgccgcacacataaaatcttctcatgaatcaattctggttgaaacgaaccgctgctacaatagaaaaaaaagaagattatggtttactaaaggcatgcaatgatgattagtactttgtgtctgatggatcattgtcatgatttatttcgaagcaaacgaattagctctgccgccatgagtagtactactatcaggtactgttaatagtggcattgtccaatttctgcactgaaaacaacccataaaaggttagacagcgccactgatacacacttagaagtcaagattggatcttgcctgccagaaaaacacggcggttagggggcaaagaaatcagaattaacccccaaaaaaaatgtcaaactaggcagcatgcctaactagacacggtcgcctgcacggattcactttaatgatgatcaaaatctctctgcaaatcttcagagatcgatcgagacataataaaaacacaggtggtgcatgtttc

SEQ ID NO: 109503 - DNA, 861 bp, Oryza sativa
ggtcaaaaacaagcatcgcacggtgatgacgggaaacggcggcaggtttctttggacgataggttgccggcacaccgcgatgtacttcttctgtcttaaaaaagacaatttttatacacgtattcagagaaacaagtggtaggagagtagcgtggcaaagcacagcgaaatattaaagctagcgagagctcaaaacaaacgtttctgttcgaagtcacagttgtacgcacatgttttaatttagcacggatgaggggagtccctttaacatgtcttgatcatctcggcatcttctgctacatggtggacaatagtgtcgttgtccatgggtcacaagggtcatatgtatgtgatatgtcccccataaaaggaaaattgaaggaatggtggaatttggttatattacgggtctcatggttatcgatattacctaataagtccaaacggcttattcagaataaaaactaatatataggtaaaacttttatatatttgttcgtatcgatttaaaaaagccaaaaaaatatgctaaaaatatcttaaaattaactcaaaaatttaagttaaaaaaatggtttttcctttgacttattaggccaaccgacgggactctaggcttaatagaaattatagaaattataggtttgtttgactgtacttcctatggctctgttcgtatgtcaaggttctcaactcctacttctcgtttttcgcgcgcacgtttttcaaactgttaaacggtgtattttttgtaaaaaaaattatatacaaaagttgcttaaaaatcatattgatctattttcttttaaaaaaataattaattaatcacatactaatagactgctatgttttccgtgccgg

SEQ ID NO: 109504 - DNA, 718 bp, Oryza sativa
ctgaatcacatgtattagtgaacacgaggacgaggtcaggtacacgatcgcctgcattaccttgcacgatcacgaaagcccccaaattagcccagatccagtagtattttgcattttgattgattgatttataccgaatcaaagaacatcaacaccagcctactgcaacttgccctgatcctaatgatgtgcacgatggacaacaagatatactatatctgttacttctctgacactatataggagtattagactatttgttataatataagtcactgggaacggaagcaatcggaaagaaatcttacgtccagccacgtcttattctgtcacctaaatctccaatgacaacttagtagagaggacatatggatgtgttccttttgatttctgtttgatctttgctaacaagtcaagctttcgtgtactcctaataaattaactcatagtatattacgatgaccaccattccaaactaactgttttcaattaaactttttaaaagttattcaaaatacattgatttatatagtggtactatacaatgtagctgtagcctccacttctgatccaaacaaacccttaattgacaaacctaggtacttacatgtaattatactaacttcaatcccgtaaatcaattagtcacaaagtctaatcttttcctctaaataatttgcagcaagttacagcaaattttactttctatttagaaaag

SEQ ID NO: 109505 - DNA, 579 bp, Oryza sativa
ctactacaagagcaatagtcttcctccttgcaacaacctattcacacaaaagaaatgtatgcagcatggattagaacttcgtgaagcctcttttcgtatttacatggaatggttcaaataatagtttgcagttcatggcttcatgcatgcccatgtaatacagtcatgtagacggtatataatcaagtcatgatttatgctcgattttttaaacgaagatgacctaaaaaatataatgggttaatatacctttactgacttgattagacttgttggaagagagtcccaggagacagtttcagtaactcttcgtttaacagtcggcgtagaagtaactgtaccggaagtaccattaggctttgctgccaaattgagctttggtggtgaagtcattgcaggcggtggtggtgttggtgttggtgttggtggtgaagtcttataaagctttggtggtgagtttttttcagatgcagactcctttttgctgtcctttgacatttgcttcttcactacagctgagccattctgactgggtgaagaagcgctagtcttgcgtgtgtccttgttaatttcttgttt

SEQ ID NO: 109506 - DNA, 555 bp, Oryza sativa
cccatgcctcaattccttagggagaggctgtgagaaatgcactgcctaattcatggaagaagacaccatcctatatgggtttcttcatttcttgacttaatggctactaggaaaggagagacctaacaagccaagaaacggcaattcttgggagggatgagcattttggtcagaatacaactcctaaatctacaacgcccaacatttgtagaggggctcttaaaccaacttctgttagttatttggcacagaaacgatatttaatgtctcatacagtcacttgcacgaaaatttccatgagaaaaaaattctccagcaaaattgtccttgtcggaggtctttggtctccaaactaagtgaaggcgttgattgacatagtaccttgaggttaccaagaaggaaagcaatcctagtacgcgaaacaagaaaccgaaaaaaaagcaaaggactaagttacacctccttgttgaggaaagaatttcttaaccgaaggattatcccagaaaagaaaaattacgaaagcaagacgcaagagaacttaaaataatctatcca

SEQ ID NO: 109507 - DNA, 564 bp, Oryza sativa
gtctactccgcgcccggccatgacgccgaccgaggaggacgagccatggtaaggtacagcgacaccaacgccgccgccgccgcctcccgcgaggtctccttctcgcgcgacaaccacgaccagctctacgtctccgcggcgcggcgtgacccgcccagcttcggctacgacatcagcgtcgcgtccttcagcggccagagccggtacgaggacgccgtcggcgactacgacgacgacgacgacgagatcgacgtgagggtcgggaagcccgtcggcgtcgcggggcttttcaagtactcgacggccatggacatcgtcctcctcgtgctcgggtgcgtcggcgccatgatcaacggcggctcgctgccatggtactcctacctgttcggtaacttcgtcaacaagatcgtcaacgtcgacaagacgcagatgatgaaggacgtcaagcaggtctcgccgcgtgcatcgccatgatcatttcttcgatttttcagcttcgattcaaaaccgatcttttcatcttcgtttcttgttcgatgccagattagtgtgggctgcaggaat

SEQ ID NO: 109508 - DNA, 578 bp, Oryza sativa
ggattgattttgataagagttgctgaatttagctagtttttgcggttgatttcgttgggctccaagttgccaaatgctgcttacgcatcgctctaggtggtttttcgttggatcaaactggtattttggtggttagattcggggcgtgtgagtggtcaccatttttggactaacgaggtctccccaattcagtaatttatgttcttactgcttagtgttactgttacgttcgattgacttcttcatggaaggactgtacaagctcgatcaatatcgttcggatgtggcttgagtgtgaaaactaatgccttgtgtcttttttagcttagtagtagatgtctctggatgcatgcgttggtggataatagtttgatggggtcatctccgcgttggatagcaattaaggttactgttttttttttggctattcttctgtcagttctgttgattacaacagtttttagctattttgcttgagtcatcgtctgttgacagtgatgacagtaatgtggttctcttgcaacgatgatgaacttataatgggcactctttttctttctcaaagattgttccatgat

SEQ ID NO: 109509 - DNA, 1252 bp, Oryza sativa
tgatggattattgattggtcccgtacgtcaagttgggcagagaaaattagcgagcaatacacactgtctagcgcatggggcactttcaggagtaaggctaactgctacaattaagtgttaacaatgcaggagtatgtatgattgtttggtattagcatctgttgccggcaatggtcactagcaataatatcaatatagcagaacaactatgagtagttttgctcaactgattaggtttttttgggtaaaacgtatccaactataggaaactatttcaatccctcgagggatgccctctcatttgtctaaaaaccattcaaaccgttataaaaatttcttgaaaaatatgacaacacttatacaacatatatatatcactccacaaaattttaactcaaaactcaactcacacatcaatatataataaggacaaattcagcgcacgaataatattcacgtccgaatttgtcttttttgcctcaatgtgtaggtcgaattttaacttgatttttagtggagcggtaaatatcactatgctctatattatcattattttttcaaaaaaaaaatacaactatttatattgaatttgaaagcaaaatttatgcaacagaacatccactcgagttattagaatccattccccattcaattgggcttaagttatagatttggaatgaggctcacatttaatatttgctataaaattcagtagctatcaagtactgtacgttttacctatcaatgtcttggaggtctctagtgctggctcaatctcttgagatgtgcgtttgtgcgctttacggtccttcaagcaaaatttatactatactataaaagtcggtatctatcaagaacggtaaattcacctttttcttttcgcgtacactaaaagaaaaaagttagtttaaactcacctttttcagaaacatatagtatctcagacctttaaactatgtttatttacttattactactatgttgttttaaaggaaaatccacaaagctcattcgtattttctttgcggggcattcatatgactatatgagaaaccgatcatacattcatacctagcagcagaagaattatagtgctctataaatcatagaacaaatcaccaagcgtaacgcagatctatttcacacgagtgctctataaatcgtggatcaaattaccatgtgtaaagcagaatttctcaggaagtgctatgtaaaggttgtgtttagttcctgaaaaaagttgaaagtttgg

SEQ ID NO: 109510 - DNA, 672 bp, Oryza sativa
ttttattcaatcatcttctgtccaacaaaatccaccctctgttccaacattggctgctgtaaaactggctagctggctaagaggtgctaagtttattgtggactggcataactttggatatacactgcttgggttgtctcatggcagaagccatatcattgttaaaatctacttctggtaattcctgtcctgtttgtttatctgctagatgtagcatactgattgtgtgtgttaatatagtggtgtgttctttgcattctaagttcgagaagcattttggacggatggctgatggtgccttctgtgttacaaaagcaatgaaacacgagcttgatcaaaaatggggaatcaagtaagatcaaactttcaggcacttttcatgtttaaggctgttgtgttagcacacaactacttttatttttgaagtcgctagctacagtttatattaacttaactggtcggatttcagcgcaacagttctttacgatcaatctcctgaatttttccatcctgcttcattgacagagaaacatgaggtgagcatctgttttcatttatttcctcatctttgctgtactgcctatctgaccattagatgaaatagttgtttagcaggttggggaattccatttgtagtgctatgggcaatgacgattgcatttctgttggtat

SEQ ID NO: 109511 - DNA, 591 bp, Oryza sativa
aacaggggggaagctgatacatgactggtggaggattaaggtggctgccatttggggactctagaaagacttaattgttggagttagaaatacttgatcgttacctctttgtaaaattcctctttgaattagaaatatttgggggatgctatggtcaatcctttttcattgatgaacttgacactatttaaagaggtatttgtaaaattcctctttgagttggaaatatttggggatgctatagtcaatccttttttcatcatgaatttgatactgcctaaagagtataaaaaatgatgcaaggagaaagaagcgttgctccaaacaatttttaaagaagaaattgtaagtatgttggacattgaatacgggatcttatagttgaaaccacataccccttgccactatactatcaagtgcatttaaaaaactatttaaagaggtatcaaggtaatatatattataatgcaattttttatacctctccaccttttatactacactatacggtgcaaaattaatgatgcattttcaaaaatgcaaactatatatcggagtggtatatattccaaacgctaacgatgtaatatg

SEQ ID NO: 109512 - DNA, 589 bp, Oryza sativa
aaaactccgcgcgggattctgcgagcaaatcttctagcgctgagcaaacccgaagcaaagcaatcacgacagaaagatcaaacaccgtccgaatcccttctccccgagatgagctcaactccagccacatcgaatcccaaatccacccagcacaaaaccttactccagaaggatcagatcgttgctcagacagagattccttccataacctttgcccccaccgaaatcgacgggctccattgcagaagtcgaaatctgccaggtttttttctaaaagagcgccgcccaggagcagatcctggcacgaggtgcgcgaaatggcgggaatcggcgcggggattggttggattcgggggtttaaagctagggtttagcgtgggggatccggattgggatttggtgcgggaggttggataccggaggcggaggagatgcgagtgacgaacgctctctgcttgccacgagagccgcctcccctcgttgtggggcgaggcagcttggtgggccgcttgggctcaactcgggtagttgggccgtaaagagcaaaagctgtctatgccgtccaagagggattatgggccggaaagcc

SEQ ID NO: 109513 - DNA, 765 bp, Oryza sativa
tcatccatgtcgtttaagaagcactcacttagttgctttcagaaaagagttcaaataaaatcaattgcaaaaacaacagcctttccttgaagcctgcattaaacacttatttcccatggcttgctgagtactcccgtactcacccttgctctatataaataatctcccccccagttgctgaagaagatgaagcggatcccgctgacgaggagttcttccaggagcaagccggctacgatgagttttagggtttcggcctagttcccaagtcgcgcctgtgttgtttggtccaagtcctggcttccgcttcccttttgtaatgcagttgtgagctcgggatctgtccgcagcccgacttgattgtactcctactctataataaagagacctctattgctgtgatattctgtcttcctgtgataccagcactgtttcctgggactggtatcgattaataggttaatttggagcgtcacgggctagttccggtcggtactagttctgggcgtgacaacattccataatagatgacacgagttcatcttttaccatctatctttttcagtgttctccttttccggtatttatctaaacgtgcatcataactttttcatagaggaagcacacacaactcaacaaaagctataaattgctcctaagcataatttaacacacgatcaattcatccaaaaatagatctcacactggattgagaacatcgttcaaaaaaaaaactcaaccaagacacaccaatcatattttaca

SEQ ID NO: 109514 - DNA, 591 bp, Oryza sativa
aaatatcaaaggagattcgagtcaggtcctatatcaaactaaagggtcagttctagttgtcatacatcctgccttggtgtaagcaaacaaaaatatgatatggtctctccccaaccttcaaatgtacatatgccatatgctcactcaagtgcacagtgcgcctataatctctggaatgaacagatgttcaagcaagctgtaacaaatacatgatttgcctacctgtcgaatgttatcatgcatttcaacctatgacctgcaatttgagaaagggaaggtaaggcttataatctatggaatgctgtcatgcatttcaacctatgacctgcaactgcaaatttccttacgaaagaaattggtaaggcatactcaggtgactgtaatgaccatatttagtcatttaggttcaagatccgacctggttcaccaaggggagtgcataacgttcccattctgtcgaccatttggaagatgacccagtattcaaggcaccaaccttgagggatttcaagtcatcgcattcttccggaaaccccttaaagagcatctgcatggatttgcgattgcaacaattaaaatctagacacagca

SEQ ID NO: 109515 - DNA, 967 bp, Oryza sativa
ctctaccctagagggtggcttaggttctgcgacgggttctccaagatcttcactcctgcttcacagctggcttcactgcttcctccacttcactagcagatcctgcagtcttccggagcttcggcgaacaactgacgatgtcttcttcttcactgacctgaccatctagtactagttgaaatccgaagaaggaagaacggagtaaaccttttgcaaatagcattaggggaaggagaaaaaggaactttcgcaaataatttttatttataaaatatgtccttgggttttatccacttggcttatcctacagtcgagatggctctgataccagcttgtcgcgaccgggaaaattgccttttcccgaacgctagtgtattaatccctgtcccaggaaaagccggggtacaccacacaaacatgatataaaagacacatctttattatatcgacaatatttacattattacaaaggcacttaaggcctgacaatcaaaaataaacagcagcggactagcgggcctacggctccatcttcacaggcgctcaactggggtataagccaggactccccctaagacatcttctccaaagcttctcttactgaagaggggaaggattgagcaagaatgagtacaaccacagtactcagcaagccacaccggcagatgcatgattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaaattttaagaattaaaacactgacttggg

SEQ ID NO: 109516 - DNA, 1884 bp, Oryza sativa
tagtggaacactctaactcatagtaccactaggtataattttaggtagatgcttcgctgattaattaggtaacattaggcggtatttacaactctagactttggaatattcatatcacctggacactttggaattgttggtttattgtggaattggattcacaccgccccctctattcaaaatccccaaaatggttttaggctgggctcggggtgcatggttttgatagtagcacctcagtcctgcctgcctgtcccggaggttctggccgtaggcgggattgggtcggtactcttgtctatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccaagcaatgtacccaagttagtgtttgaattcttaaaatttgctcaacaactaaaatgtggaatggttggcctgggttggcttgggacgagctgggactcagggtcgggttgccagttcggtctgaatcatcgtaggccttgggttaaggcaggttcgtgagggttcacggccttgattaataatattgtgtagctctaggatcgtcttataaaatggctttgggcaactaagtgacttttaaatgctgttttctgcaaagcttaacccctatattattaccccttgtaccccctttgcattaatcatgcatctgccggtgtggctcgctgagtactgtggatgtactcattcttgctcaatcttttccctcttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgccttttgtatcatgtttgttcggtgtaccccggcttttcctgggacggggattaatacactagcgttcgggaaaaggtaattttctcggtcgcgacaatgtggataccccaagacaacgcacatgccccgcagctccaaagcgaagccagtcaagtccagtccacgacgggtgatgctgccggccatctacaaacaaaacaaaatagaaaagcaacattttaaagattagattttgacaataaatgaagcagcaggacagagaaagactagaggattttcacaaataagaaaggatttttatttcgaaaatatcgctaaggcttgggatctacggctcgtcctagggtcaagggggctctgataccaacttgtcacgaccggaaataacccaacgggcgttccttacgtgcgtgtattattccttgtcccaggaggcaaggtacaccaaaagttgatacaattcagagtttaacaagcggaagcgtaaatagttatttattacatgggcagcgacggcccagcacactcaaagacaacgaaaaacagcagaagactaaggcgacgaccacaggcgcttgacggcaggcacgagctagacaccaaagccttcatcctccaggggctcctctgctgggtttgggaaaaattaaacaagactgagtacaactaccgtactcaacaagacacacccacaagtgcagcataattgcaaaggagtacaatggagttataatataggggttaggttttgcaataaacagcatttaaaagacccatagttgctcaaagctaaatttaaaacacgatcctagaactatttaatattattaatcaaggccgtgaacccacacgaacctgccttaacccaagg

SEQ ID NO: 109517 - DNA, 579 bp, Oryza sativa
ggtccagcgtcgatctcaagtgctcaagcataaatcctagttcacaagcacttaatcccctgaaattccaactcaaatcccataaagatttgcctcaaaggtaggagagagaggagagcttaatgagagagagacagagatggggtgaaaaatcaaagaggagaaagtgtgggttagtgggtataaatacccccaactcccaactagtcgttatggcatcgccaacacgatcatggagtctttgagcatggccctagagcctttggcctgccacatcgttgtggcagaaactgtggctcggaggccctggaaatgggcatcaacactcgaggagactttctggagtctcccagccaaacaaaaggaataagttcatcaaaggtcccttaacttgtcaacgaatccgattttcatccttcaatcacaaaaccagatacaacggatccctcaactatcaaatctggtacgaattaggtccctcggcggtttcaatagcagttttggctgacgtggcgcctacgtggctaatttgactcggtctcgatctgacgtggcactgacgtggcgcttacgtggcaa

SEQ ID NO: 109518 - DNA, 572 bp, Oryza sativa
ttttttcactgacgaagtagcagtattaattccaattaccactagtaccgggtggttcacctgatggtataaaaaccacattctaaaaatagcagtagtgggctttctattgaaaccagttactatgtgggggggctaataaaaactcaaatctttattaatggggtcttccatcttcattgagtcgtctgcaggtaatatgtcatggatccttgtgctcggttcagttccgttcagctgttcagaccttgatctgtactgcctatctaccttgtttgaatgaatgccaagggactatcttgtggatttttttttattggcacacacactcactgactcagagatcaattagaagtcgagaaatattggtttcatgcaagcaaaggcgaaacaataatcaagttaaacttcgattcgaggcttgccagttagccatcggttagacaggcgtacctctgtttggatcggtcagcatagctcagtaaacatcggtacatatgactggcctttgcgtgaatgctttgatcatctttctaattaggaccaaatttaatggtcgtcaacacttggtt

SEQ ID NO: 109519 - DNA, 624 bp, Oryza sativa
tgcgcttaaagctacgtacgacatatttgatggaacttttggaggtgatcgagtacatttttcctttccctttttattgtttgcctttttctctttattttccctttcctttctcccgatacctttcgatgttacctttcatttctttaattaagatcgatgcatgcatggctctggctctccatatgaatatatgatctctagctcatctttatatacagtacatatgtctctcctttttatactgatgtgatcgatgtatgttaagggtgggtttagttggggaaaagaaaatttttgggtgtcacatcagacgtttgaccgaatgtcggaagtgtttttggacacaaatgaaaaaactaatttcagaactcgtctggaaaccgcgagacgaatctttcgagcctacttaagccgtcattagcacacgtgggttactgtagcacttatggctaatcatggcctaattaggctcaaaagattcgtctcgcgatttatagctaaactgcgcaattggattttctttttgtccacatttaatgctccatacatatgtccacagattcgatgccatgggtgaaggggaaaaaattttgggaactaaactggccctaatcttgaccc

SEQ ID NO: 109520 - DNA, 688 bp, Oryza sativa
agctctcaagtatggcgacgatgtcgtcgaactgaggccttctgtctgggttggtcgcccagcactgagttatcagatggcttattgccacagggcatgaaggaggcagtggtggcctagcattctgcacaaaagctattagttgcaaaagtccaatagatgaaggtcatcagtaacagataggacaagctaaccgactcttattttccaaacttatgggatcatatagatatttgctgcgcaacacaatgtgtggaaaaacaccatattttcagcctattcaaatttcatcgctagttgagcagtaattacctaaatggatcgagcatgtttaatatgttttttttttcaagctagaaaccatgtcaacagaattacaaacaatttttggggtgatacagaggatttaagcaaaaaaaaagttcaggcttaattaaatcctctaattacccgcaattttgataccaataaagttcaggctaattaaatgtccgccatagtttccataagggaaaaaaaacattttttactctcttacagaaagaaaccaaaattttctactggtactgcgactgaaaaggcagcagcatctcatgattttaacagcctacattatagccaaggaaacaaagatggacatgaagattggagaggtggcatgtcaaaaattcataccttcaaggccaca

SEQ ID NO: 109521 - DNA, 624 bp, Oryza sativa
cctctcttctttccgtcttgtatatatagatttctgtgggttattcccgccatttcaagcaatccatattccgtccgtcagctactgctagtggtaggctagatcatcgatgaacgccatggatgaggaggagcaagagcagcctccccagcgctactggttcccgtactggaccagccctcaccgcctccgccgccgccaccgccaccgccctccagctccaggtacaggccgccgtcacctccctcatcgcgccatccccacccaaccatcccagctgcccgcgccgcaccaccgctcgggccaaccaaccgccgcttgcatcagcagccgccgccaccagcaagcagagatggtcgtcacgagcctcctcccaagcccaaggacgtcgtcgtcatccccaccgacaccgtactgcatcacaaacaaccaccacccacgcatcatcatcagcatcagcagcacaaggtgaaagatcaggaggagaagaagggcgacctgcgcaaggacctcaaggcggggctcgccggcatgctcagcgccgcctcccacggccagcaagggacaagcatcatcacgctggccggcgacaacaagggcgcatccatgaagatatcctccccc

SEQ ID NO: 109522 - DNA, 678 bp, Oryza sativa
tagttagtgctggtgattctgtagccactgagaaaaagagaaaaaagaagagggagagagctgatgataccgacaacgacaaagagcaagtagagcatacaaggaagaagccgcggaatcggtcctgattttaggtttagtgcagcccattctgattgaagctgttccagaatttttgaaggtggtgtggtgaggttgttctagctgctgtattctatcttcattttgtcactggggttgggttgtggacttcatggttttatcttgtaatatcaatccatatgccctgcttttgtaacagtgaaatttacattgttgttgtcccttgactccctgttactctggtgccgtcggttgctaatttgctgtttatatcagtgcttcagagaatttcttacaaaacagtgcattcaattttagaatattcaataccattcaattctataatgtttggttggcctttcatttctaacgactgaatccatttgaaacaacaacacttctgcaatgtattgttaagagatgtaatgcttaaaacttgcacgtatgaattgatgtggttatttcagctttatcgtcttgtacttacttgcctgtatcttgtaaaacataaacttgatctcgagtcaaccatgtctatctgccctcttgtagtatgagaaattgtgtaccatgtat

SEQ ID NO: 109523 - DNA, 635 bp, Oryza sativa
ccatgcaaatgcttgttgtgcttcatgcttgagcttgcactttttacacatgtgccactggtgattgaaatgccttggacctcaattctctggttcctttggttggattaaatttgaacttctggatcattgcagaagggctcatgtgactttgcaacactaatgtatgttgagctttggtgtgaggaaaaattcaatatgctagcattaggacctccagatttttcgcacgaagagtcggtctgtctcttatcctttcttcaactattactttcttgtgtgtgattttagctctaccgtagttttgccacatgcccatttatgtttcttgcctttttacagttgcccccacatattgatctactggttgcttcatttactcgcataaatgagctggacagcatttatgggatcacactggcgaatgaggtttctcataaaaaaattctcactattttttgttgagttttggtaggcttaggttcatactttctatatgaactccaagttattcttaaagtggtcattggtcatggtacatttctgtatgaacttataagttaggggtatcagatatacatgtgtagacccattatttaagtgttaagatcttaaagttatgttttcctcttgtt

SEQ ID NO: 109524 - DNA, 847 bp, Oryza sativa
gagtcggtacctacggaggattttatagtaatggtccgtacttttatttcagattaacggctaataatatacagttccccaatgctaacagcataactgtgccctcataacctcatttatgtttgagtaattttacagctcttgaaaaattactaaaagtcatcatgtaaaatttagtagcacctgttaataccaaataccaagacatgtacataagctctagatcttacgcttaaagtttttctcttaattaaagaccgtgaaatttctctttacctcagcgtggacccaaagtagtgagcatgtgagtactatcttcacgtgcatacctgctggtttcaatttcttttttttaaaaaaaacttattttacaattaagcctttctaaaacttaataaaaaaaatagatacatagctcggtgccaagggtatttggagctgaagttgaatggtctcagcgtcaaataaagtggtgtcgaaacctaatcctcagcacctacctccgtgtgccacctatatgaacaacttccctctctcccctattacacctttttgaatcatattgatttgctatcaataggatataaaaaatgcttattgcatgcttcctaagcccgaagtaattaattcaacatctttatcttcaaggaaaaaaaaaaaggttacgataatactcgatttcttaattaacttgcaatgatttttttttcttttttttaggaattgacaatgagttggatccttattgggttcggcggtggtggacggcagggagagacggcaagaaagctacccaaagggtggggtgtgcatgcatttaattgaaatatatgtgtacaacatatat

SEQ ID NO: 109525 - DNA, 574 bp, Oryza sativa
gatattaggattctattgtggtagtagcgttaatttatctcctagcttgaaacctctgtagaacttagtggaactaccaaactagactgagggttccgaagaattgatcggagtgttcgaggaagtatttaatcaaagttcgtttaaaattataggtttaatctatttaccctcccttttgggcccaacaagtaactttcagatttaacatctatgtatttcacgtgggcatagacacacgtaaattctctaaagagataagaaaaggaaaatatatatatatggtgttcaattaaatgggcaaagctaggcaggaggtaaatagggggcagtgggccactcaatgactgtattgtcgtactggtgaggttagtactagtactggtttggaattggatgcaaaaaaattaatgcaataaatatggcatgctaagtactcctttggtaaaaaaatactcaacttagaagtgaaaaatatggagagagtattactaagggcatcaggcaatgagggttcatgcaggccgtaaaccagggagcaggggagaagcccatgaggctgttagctgatggg

SEQ ID NO: 109526 - DNA, 763 bp, Oryza sativa
acctgcatttagagtacccaagtggttgtgaaatatcactgtatgatttctagaacatctaaaaatttgattggtattttattgcacatttataggttgattcagttctgaggttgttgggtgaaatgatcatgcgggtgagcttctcattcccaattatcttaacagaagctctaacatattctgtgcataatttcaggccagttatagttatttcgagatatcattgatattttgtgctttccttcttcaaggaccaagttcatgcatcatttgtgtcagaagatacatgggacctacaaatatttaaacaattaccatcatcgtacgtatgccctctttctgtgagactgaccatttattagttgtaatcttgcctcattttttcagtacaacctccgttaaaaaatataagaatatttgaggctgaccatgggtattaagaaagtaggtggaattaactggggaaatgttgtgataggttaagaggaggaagtaggtggagaaactccagaaatccttatatttttggatggaggagtacctgcatgtagtgagatatgcatgggccagttaaaaggtccaaactaccttcagcacagtgctatctatgtacctgaatacatttaacttgtttttgcatgctattttcatgtcagttattttctattgtcatgtgaccctacctactagtctttcttctcacggtaaatatctcctattctagaatatattgcatacagttaaactgcatcttgatttc

SEQ ID NO: 109527 - DNA, 505 bp, Oryza sativa
ccctgccaaaaatatcagcaattgaacttacaaatctcggaaaaaatagagaaaatattgacagcccactccagaatgtagtttggaaatggatcataatgtaaattgaaaaatggataatcactaaccacaaacacaaataaatgcatgatgaaatgataattaaaggtccaaataatgggaccatctatctggatttttttcccttttgtagctcacatttgtatgttgaactattcaagaaccattaaaattagttatgtgattcaactagtgaaagcatcacacttccattgcagaatttaagttacaataaattacttagatgagctctatatatatcacaaatatgaagggcatctgtatatatctaggaataatcagaaggaatataaagcatacaaatgtcaaataagtccttgtgatgattacagtgataaataattatgttctactgttgcctaaatgtgtgatacttgtataaagtttactgatctatcaccat

SEQ ID NO: 109528 - DNA, 703 bp, Oryza sativa
ctgcaagtgccaacccatagtgcaaagctcaaactactccactgtgagacaaaaccacaaaatggtcagaaaaaaaagacggtatgctttaaagagcatactgactctgtaattagtctgtatggtggtgaacagatcaaaactatggcgaaacattttaggaaaaaagaacttgctatctgtagttggcaccataagcaggatgcaaaaatgtgctaccataacaggaaaccaaaaccacacacagcttcctgtacttagactggaggatgctcccagtatcactccactaacaaaccgcaacttgttcatctcacataaacaaatgaactgcatggcatacatcagaaacaagcagcctaccaacagttgacaaataaatcaatagcagtacctaattctgaaactatcgccttttccccttccaagagtacgggaatggaataatctaccagactactatcagatcgcgaccaatacatgcaagaactcacgtagcaccttggaactaagccgaataagcatatagacaaggagcgggaggggaacacgagtgatctttacccagggaagaggatgagcggccgaaatccggaggagaaagaaaataaggtggttcgtgtgcgggatagatggaggagcgtcgaggtgcacgcagcaggtccacttgtgctcgccatccccaggccctagcctcatcgcc

SEQ ID NO: 109529 - DNA, 564 bp, Oryza sativa
ccaggcccggcacggcacgccggcctgtgggccgtgccggcacggcccgtttacccgtgccgtgtctgggccgacgccatagcccgtgggccagcacggcacggcacgtttactgtagagggctggcacggcccggcacggcccgcgagcacggcacggcacgggatcggatcggccgcgcacaccgcggcaccgcgcacgtggcgccaagcggccgagccgccgagggcagccgcggggccaggcggcgggaagcgcgcgtcgcttcgttcgcgcgtggcgcgtggcaagcggcgtcgcgacgtgtcggcgtgtcgctggggctggccagctgggaggctgggacgctgcctcacgctgggtcggtcgctcactcgctctcgctgcctgtctgcctgtctgccactctgcctccgtgcctcgttgggagcagccgagacagcgactcggcgagaccccgtacggcggccgaacggctagtcaaacgacgaatgcgagagtgccacgtgtcccccaacggctagtgagctaatccaacgaccagaagtagccgttggagagcaa

SEQ ID NO: 109530 - DNA, 974 bp, Oryza sativa
tttaaggtttccttgctgctgctgcttccaacggtaataaacccaaactgacggtctccctttctcgtgcctgtccacgtgttcacctttgcagccgtccagatggcgtccctgacacccgaagctgaagctcccggaggaggagccctgctcgccgccggcgacgacgtcaccgccgcgaatctgctcgccgccgccgtagccaccgaggtgagtaaatctgtccagctcaaagcccacagctccgtactgatgatctcttccttgtcgttttactactcatttgtgattagttttttttcctttgtcattctgtgtttgtttactataggcaaaaagaaaaaaaaagtactagtactagctcgacgctgctctgcaccgttgagcgagatttttttattttttttgggtgagatattgtctcttggttttgaaggacttgccgggtgcggattcgtggggtgggttttagggtgcggttttcagctcgggatttgagttccgtggaggtgggcccgggggggggcatagtgtaaaaaagcgcccctttgtttcttgcttaccattccagcccgaatattcgcttcttctcaaggacatagagcgaatattcccctctttagatatttctttgtaaaaaaaaatctggtgaacaaaagtaagtgtgatttgagttgcttaacttgtactcactccggacccatcctgtcataggttttaatatattgtgtcctagttttaatatattgggacggagagagtaagcagcatgattagtaggtgatttggttagtctagcgatgtatggtacgcatctagttttttttttcacataacttttttttaagcttgggaaagacttgagcgcgaagggtgtcgtctcacctgcttgcgtcggtgtatatggctgtactttttttttctccaagtgtgtcgttttagctgtatatgcctgtactattgtactagtatct

SEQ ID NO: 109531 - DNA, 2031 bp, Oryza sativa
atgattatagaacccagtaactgaaaggcatacattcttaagttttacatatctagagtgcttgtatctattatctaaaaaaaaatctagaatgctactggtattgcagtgtttacctttcggaatgattatagattgaactaagaggatgttcagttgagtatatatctctgtctatttgaaagtaatactccggatttctgatatgatgtatctagctcgaagtttctctggaacgctgtcagtatggaagtctttggcaagtttgaattttagttccagattacacagcttgggctttacataacttttgtgagtgcagtagtgcagggtgaggtgtatacttcatctactacctccatattttaatgtatgacgtcgttgattttttgtccaacgtttgaccattcgtcttattcaaaaaatttatgtaattatcatttattttattatgacttgatttgtcatcaaatgttcttaagcatgacataaatattttcatatttgcacaaaaattttgaataaaacgaatggtcaaacgttggtcgaaaagtcaacggcgtcatacattaaaatacggagggaatattaatatgcacagggataccgagtacacattcacattctccgggagtacagcttctagcctcttaggggagcttgaatttatttcagtacttgtattatgtgaacatgatgtgttgattaaaaaatatataatgctagactattttttggctacaacttcctggatggccaatgtataagaattcgatgcatgatattccagaaatatatccatacctgcaggagggcttgaagggagataagctgctgatcgcgttcctggaggaggatggagaagacgcggcgctccctcatcttgtgcaggatgcccacgctcagcgccgcagcgccgagtgccagcagcagcaggaggaggtaaggaggtggcctcttgttgttgctgcttgccatcgtgtagcctcttgatctgtacttgcttgaatccatgccccctcttattgacacccttccagtatcttgtgctgtttactgcagaatgaggctactactatggcagcaatatgaagaaactgaacttgtctttttggttgcttggattctggaaagaaaagtaacttgcttagtgatggagaaacatggcactgggaggtgcaggctgttagctagcgtatactgctatgcttcacttacttcaaggtgaggcacatgctcttcaaaatttgattatttagtccttatagagattaggagcataaagtttggcacttgacttttgttagtgtctcgtaagacgctggcaatagctaggatgcctgcacttgtatctgatcccagagtaggatgtcttggatcacaaatttattccttggacaaacccacaactttgcatacagtccattgaactcttctttctataggaaagtggtccgtatctttgggatttctaccaaataagcaaataagcaattcatgacaataattttgacaaacgaactgtttacaaaaatggcttcatgagaagaattgttacaaacgaactcaggaagccataatcctcagcaaaaaatatttcgtagagaaacgtggaaaagcatactctaaaatttgatctcaatcgcaaacgagtcctggcaggctggcactctaagcaatatgaattcattatacacaaatatcctccagaatgatgcactgtgagagccatcttggccctatctcttctgaagctacaagctcgtagaactagtgcatcgcttccaagtaagaagtttctaactagtaaaccatacaactcagttctagcccaaatgaactggcaagtcaatggctgaagctagctgtccttgtgaattgtgatgctttggctatctgtccttgggattctttagttcgaagttactctaatcaatgcagcctgctgacctcttcacaactgtgaatatctcgatttctttaaaattttaatactattcatcagttcaaccaaagacgtgcgccatgttt

SEQ ID NO: 109532 - DNA, 704 bp, Oryza sativa
atatctagacaatcaagccgctggatgtttcatagagtggtggatatctcatatcatctaagccaacgtcgttatttaacctaatcggctgccttctggtaacagatgttagccgattgtaggttagatgatgatatcgtcaaggattatgcaagatatatgataactcgacgaattacgtaaacaagactagagtatcataaggatggaagcactaatctcgagaacacaaaccgccataacaagttttacctcttgttgaagatcgaaaccgatgcagctcaacccgaaagcaagaacttgttgaaataaaactaaagcaaaaagggtggcgatgcgccgaaattgtattgaacgtgtgtgttatccattacatagggctcggggcctatttatacccgagaattataagatatgtccatattggacacgactcttatccctaacaaactctaagataccataagtttttgcggcagacttttgcccacatttatctctaaggaatttacataaaatatcctaattaatagatacaattgccttcccaggactctatccatgcgtggcaatcatcttgaagcacatcaattcgaacccgatgtcgtacacaagtcatattatcggaatcggctgtatcacttaacacagtctgactcagacttagccgatctcaatcgtagccgatccggactccagctgat

SEQ ID NO: 109533 - DNA, 739 bp, Oryza sativa
tacaaagagctggagagaaagagcgtttgaactctagagaccctctccctactctttttttttccgtcccttctacgagctcaaatcttctccctcccatttttcttggtaggcatggtcctccttttatatctcaaggggataccacatataccatttctacctacccttcttttgggtggggacccatcctactttgatcaagatttggctcgtacttttgtctgacaccgggatagccctgtcctccctcattaatgggcggagatttgcaatggctgctgtttgaatgaccctccgatgggatgggtcataccaacctccactccgtctgaagcaggtgcaacgtggaagcacggttgtttgccaatgacgcgaccggcgtatgaccagtcacagaccggtcattcttgtccaccacgtgtcagtttagcatgctacacgtctgcccttcttcatacaatagcttccttgcaatgattgcgatgaagcctggaatgtatctggctggggctgacgtgccaactccaggagtccccacgccggctccgactagggacgagtgcctggaggctctcatcattccgacgggacggggcgaggcgtgtgtcaggccgcctgttgccccttaacccgcgatctgaccggtctgtgaccggtcacacactgcgacctgtcacggaccggataagcctgcgctatactgcattaaatgcggcgtgatgcgctcgtccaaccc

SEQ ID NO: 109534 - DNA, 1287 bp, Oryza sativa
tggtgcgcgctaggggaatcctgcccgtcagaaggtcctcggcgaggtcgtccaccaccgcattgacctgtccagcagccgcaggtgaccccaactccctcgccaacgaccggaaacgtgatgctattcccaagcagccggtggctccatcttccacgcagctggctagacattcgccggtcccgtccatcgccgtaggtgaccccaactcccgcctgctttccatgtcggcttggcacctccctgtcccgtccatcgccgttgtttagagaactgctggcggcggcagcagcggactctcggagtagcctaggagtcggttcccatcgaccacacctaggggcgatctgttgtagctgggtctactgatcgatgttgctgtgctggtgctaatgttgatctgctggcctgccgctgctgcttgttgcttctgctactgtgttgaactgatgctgatcctagaagtagccattgctcgtaatggctggctggctgctgcttactggttatgttggtttgcttgctgctttattggactgagataattttctactaaaatgttgttggtgtgatcgcattgaaatacggatgttgtactaatctaatggttgatgttgtactgagatgttttcttacaagtacaaatttagatggtagtttacaaacattgcaggacaaaatatgtagaagtacagtcgtggcgggggagagcaacgttgtgggatgggaggtgaatgcaatcgtgctgacagcaagtgtcgaggctgatcatgatcactgcgggaggaggaaggaaacatatttctgattgtagttttatagggtctacttttcagtcttagagaattaattataggtcatctcttggagagatgattattttcacaccttaaatttcttttaggattctgaaaaaccaaattttgggatgctgttggtgatgctcttataagtctattggaggcctggttttgatcaaattctcaaaatttatgtttttaggaacctattttggagatgctaccttctgcagccaacagatacgtagacgcagtcgttccggtgtgaccaagccgtaacggtaacattatgcgtccgcctttggtccggtgtgacactgtgaccccgccgtaaccccgtaacggtaatattatgcgaccgccaggtggggggccaaaggtcgttccggtgcgacccaaacccggtggagagtcccacacgccaaagccgcagcagcagccgcaacttgcggcggttccaacttccaagcaagcaaagcaacccacc

SEQ ID NO: 109535 - DNA, 890 bp, Oryza sativa
acattatggagatcagaaagaatcacaaagcagaagttccttgctttgactttgagaagtgcaaaagaaagaaattcgaggagcttcaagtctctgaggaatgtggagtggtaaaatacataaccatctttctctttcatattttcattgacatacattttgttatggttcagaagggacccagtatttttcatttctgggtaatattcttggtttggtaactaccatgtcacatatggaggggggttatttttatactacaatattcgttgttgcttaagaagctgtaatcccacatgatgtaatacatactatgttacttggactgtccatttttctgtcccctttctcctcccaactcatcatctccttcactgtctattgaaaccatacctctcctcttatggtgtcctaatactctatcagccttcctcaatcacttttgacctcactagggatcaccatgactccatgagaatgtacacaatcaaggtgtgcgaaagcagaatcttgtgatggagttcttgggctacttggaaacatcaatttagctctgagatcatttattgggttcaacagaagtcagaatatcagagcacgccgtttgagcaggatgctggtgcataatagaaaaagggcggaccggctgacctgctttgccagtcagctggatactgcaggactggatgtttatgttgtatgcatatttcctttgaacacatcagcgtagtagtttagatggccattgaaacaagtgggaaaaccattttttcgcatatatttggaacactgtgctcttgagccttagcaagaggcgtttctagacccaacggccatatcttagctggactccaagagaactgcggcctgtgtgttctcaataagttgct

SEQ ID NO: 109536 - DNA, 592 bp, Oryza sativa
tatcgccaacaaatcgtgcaatcttttcgctgaaagaagctcgtattgtactagcagaggagtagaagttagtaagcaggaactatatgtctaatgatcctgcaagttttctttgttggagtgaaacgactttgtaaagccaggctgatttttataaggttcttcagagaaaaggggaaaaaggaagcctaggtctatgctgttttttgactgaatgttgtggtatgagaaagaaaaggtcgtcttgggcaacacaacacgcacgcaggctaaaagtgtctcattgtctgaactctgaataacctgggcaacacaacacacacacgcacgcacgcaggctaacctgaagaaaagaacaagcccacagtctgttgttctcgagtgaatatattatttttaatacaatgttttattgagtgaatgttaagcaatcgttttcctagatgtccagactcttctgatagtgttcttcgaccaagcaaagaacaatacctagcatcttttttcccttatgctctcatctttgttattaggttggtgatgtatccacctccccggttgttcagcgaaaaaccgtgatgtctccgttaag

SEQ ID NO: 109537 - DNA, 3106 bp, Oryza sativa
attgggaagagtatgggggaactgttggtgatgctctaaacatggctcctaaaatttacgcacacccaaaaccagcaccaatcataactagatgttgggcaacttgacgcgctcccaatcgcagaaatcgtgtgtggtcgcgccaatttttctttccctccccatgctttccccaaccgcgacagctatttccccgaaacaaatcgccctctttcgttcgtcgcccgctaggtcgagaggagccacgtcaccttcccctcctcgcaccagctccgttgtcagctccatctaggtcactgtcggcccgacatccatagcgccaccgacctctaaccaggttgccatcgactgtccatctagggcgttgccgaccctccatctagggtgccaccgtccgtcgatctaggacaccgttgcccgcccatccaagtcgccgtcggggccatcatcatccacttcattggcatcatcggtagtctctgcctcttcggccacctcgatgacgtgtgctgctactgaatttttaggtaatttcagagtaatagatcatttcttttctctttctctccatggatctaactccctttgagttcaattgaggttgactcatatatatataggtagtgcatcatgcacagtagtcatttcttgttgaatgatgcagtgcaagtgttgctgtgatgatctaggtaggtgctaaaaagaagtaatgataaaatcatttgttcttaatctacaccctaaagttttattaatgaattgtactgaaactatattttattcaactagacaaatggtacatgctagtttcctatactttaccgagattttatttttgtattggtatagttgacatttttttttgcctaaactagtataccagctgcatttctcttctgcacaaaatagtcatcgtgatcctttattgcattcattgtgcagagaaatagaggtcggttcattctattcctaccaagtataactaatgagagacatagcatatagctaagataaatcaaaaaaaattggcttaatacaattccgcgcttgaataaaactggaccgtaggtaggattatcctctcaagtgtgtgcttctctgttgcgatcaatcgattcatgacccatgatagaaccgccatgttttggtgcattgacagagtgccaatagctatgcacaatttgcgttgcggccaaaaaaaattcatcgtcgttgtcggagatgattcctccacaagccgtcgaaacgagaagcaaggactactcatcatggatcaaatcaactgccaaaccattattcatcacaacaaaaataagtttttcccctagcgaaattgtcggatcaaattaaaaaaagggacatggttgaaagaagaaagtcctaacatgagggtcgcctaggatattaacatgcagattgatgatacggtcgtgcagaggatcagctaagtcttccgtttttccacattagaggcgaaatatttcgtcaataccactgtggctggtaagagattctctagtggcagcaggagccagtgtcgtcagaaagggcagcggcaagataaggagagatatgatccatgcgtatgttaaaaaaaagggtaactgttaacgacagaattttgcataagatttggagaggaagaagaaagatcgagacggatttggtgtggaatcgagttgatctccaagtcaggctgcacatcggctgagtgtcgtatcggctggaaaaagaacaaaggcttaacttggccgatatggcaagtagacgatagatataacttgggctcagcagggcctagattgaggtaacagtcattgccaattagagatagagcttaaataaggcaattgtatctattagttaggttagtttaagtcggttgtgattagttttggtaagagaccactgtatatggtcttgtttgtattttatctttagaaaatttgagtcgtgtccataatggactaagtttgtactcggggtataaatatgaaccccatagctatgtaatataggagataatctaatacaacttcggcacattgccaccctttttgtttttacttttcgacgactttgcttcgcaagaggtaacacgtctcaatggcttgtgctattggggctattatgtccctttagatgttttaatccttttatcatgatcatcttctatcatatgtcttagctaatctagtcttagtatctagatttatctctatcgggtggttctcgctttagggttcttgccggtatcggctaaatattcctattagattatattagttaagacatctaccatcctgaaaagtaaatatttacttgattgtttagactctagttttttttatctactttgcgatgcatcatccctagtcttttatcgaaccctagaaactaacctagaaacaattataattaaggatagtattggagtttcagccgatcctacctaatatacatgcttctttaccaagttttatgtaatttatcacttatatagatagatcactctatatagttatatcaaggtaaatcggtatcggctgtgctatctaaactattaaccgatcacagtttgatatttttatatagattgatttgcctatataagtttgtactagagtattagctggtacattatatttttcttgctctaaatgttgttctatcggctatttacatgataccgtttgaagtctatttatcaaacccaaacaaatgatattatagccgatgagacatgtttagggtttattatgttctatcttaccaagtccatagccgatctggtctaactatatcggctgagaccaccaacaataccctattggcctatcagtcgatcggctatcggttgactaattgtagcacgagttccaatatagtatgtaagagagatgggtggattagatattaatgatgcagtatatatctataactaactattgtataagtggctattagattggctatatatgatatttcaattttgggagctagtagatggctatattattaaacttgctctaatctcacctcttcgtctgtctagatttttaccccagctagtgaaatgcctctaatttgttgtggaattaagaaa

SEQ ID NO: 109538 - DNA, 812 bp, Oryza sativa
gaggtgcacaatcatggatctggatttttacaccttgagggcatgtgccccgtaatctccaaacctctcaaatatcaattaaataattgaaaaatattcaaatattaaatttaatttatcatttcagaacatttcaatttgaaactcagatgtgtatatgaagaaacagaagaatgactccacccttgcatagcatgagcaattcatagctatattttgtttcacttatgacttgacaatttgtgcctttaacttcattcaaaattttcatgactatttggatggcatgcaaagcatgaaggcacatgctcttaaggtgtaaaaggacctttcccaaaatcatgcaaaattggttcattgtgaaatgtgaatatgtcgtcagcgtatatgaaaattaattattctacatgcatactgacacctgcattattttctttttcccttcaaatgtcccttaaatgatagcttaagtcataaacttcatttgtgcagacacttgaatccttcttagaggagactcttgacgcgataccaaactctgtccttgacgcaccaataggtaaggaggcatacatcgaggagggacattttgctgatatggattcattattgccgcctagatattcatcactgaccaacggtagctgtgaaattccagcacttgtaactgcatccacctgaccaccatattttccgtggagatgctaaaatttactgaaaaaaaaagataagcctgcaagattactgttataatacagacccctcctgggttagattagatacgcgggaacactattgattgtaagttgaaa

SEQ ID NO: 109539 - DNA, 716 bp, Oryza sativa
tagaagctgcgtcgaattcctgcagcccttaaatgcaaaatgtgacggactgacaggtgctgaaacagaaaaatgagatggggatatggcttgcgttgtgtgaggcatatccctagctgagtgcttaatcacttttgctatgggggtgcaccctacattgggcatgtcctaataaatgttatgcttgttgagttttagatgtttaatgggcattagctttatggaaagaagagataggaagtcaaaggtcttattggtctttcttgccctatgtgaatatgagacaattttggaaagtgaataattcactattgaaagtgcaagtcgatgttccagatatgaaagtggagtgaaatatggatatgaaggttcaagtccagctccaatctaggtataaaagtgttcttctctttagtccgcttttatttttttctttcttgggagtcttaagataggactggaaatcgtgttttttgaatatctctgttccggcaaaagaagtaagtttgttcgagatcgaaagagtgccctcgggagactagactgatagtaacagtagcgcgctttcaattgaggagagctgttcacaagtagtggttttgagctctttcttgttgaggttcagaataggtaattccttcacttcagttgcactagtggattgaataactgtttagcatttttccacttatccaattctttgcaagagtattaga

SEQ ID NO: 109540 - DNA, 865 bp, Oryza sativa
gggagagtgggggaaaaagtggaggaggtggaggggatcgattccacgcgctcgtggggcggggtgaagcgcgggaaccgcggcgtcgtggggcgaaaccggcggccatggcggccgttggggcgacgggaggttggggaagaagatgacaggtggggcctcgggtcccacctgtcggggagagagaggggaaaacgggcgagggaggtaaagcagacttgagggagagagagagccgagcgggccgagggaggaggccggcccgagagggagagaaaaggggcgcgcgggccgcgggagggtaggaagacttgggccgaaaaaggcccaaagagaggaagggggattttaattgtttttctttttattttaattgatgcaatgatctttgtgctattaaaactatttctcgagctccgaaaattcacggaaaattccggagagtacattagggcgcaaagaatattacaaaatattcccggccaatgatttttaaaggaaaatttcaaatttcctctataattccacttgattaaattggtttaacttttatttaatttctagaaaatgtattattaattgatttttattcccgaacgaaaatcggggcgttacaaatctaccccccttacaggaatctcgtcccgagattctgggatggctagaaagaaagctggagctggcgggcggtttgactgatcggacggatccgcatactgcactgccccctttctgtctcgaactgactgattgactgattgtccagacttgcacgactgaactgattgattcaacttttctgttcctttgctttgcaagactggactgactggttctacttcaactgacccagacagggctgtgg

SEQ ID NO: 109541 - DNA, 1364 bp, Oryza sativa
gccgatcgggtatagactgacttaataaggttgttctccctaatgggtgcaggatcaaactaggtggcacggccttgacacacttaagggtaaccttggacctacattagagttaagtagatatcctaggccgtcgtgttttttgttaacaagtggccgccgccagcgatgacctccctcccttgtcacttccccatcctcacttcccttcctcctcgatgtcttcttttccaagatttgctacaaagaacatcacatgatgttgttttgtttgttcggtaaattctagcacagtagaaaattttctgatatgagcaagtatttattggataagtgaatctacaactgagttaattgagcaagacttacaaagtccatggagcatctgaagtttttttatgctgttgattgatctgattctgctgaatttttttgctgttgtctgatgatctgtggtggagtggttatggtgtgtaggaaataaacaacagcaatgtaaaaggaggaagcataactgtatgctcatcaactactgattataattcattcattcctctgtatttggtacaagaggggtaacctcaccaactctatctatagaggtatctctatctagctattttaccttcacttctctatccaaacaagtgataggaccattctatccctttttatccctcaaacaaaaaagaaacatggttcattccatttctcgaaccaaacaagaaaatagaaccatcctatctatcagggatggactcaaccaatcccatctactccctccgttgcaggttataagatgttttgactttggtcaaagtcaaactatttcaaatttaacaaaatttatagaaattttttttttcagctcaacacaaatttattatgaaaatatattcgactattgatttaatgaaactaatttggtattataaatattactatatttgttcataaacttaattaaatttaaaatagttcgagtttagttaaactaaagttaaaacgttttatagaaacggatggagtaattctcaaaccaaacacatgcctagagctgccaattccatatgggtcggctcaattcctagccgttgcgatccgttgcgaacttgcgacagactactcgtcggctcaattcctagccgttgccatatactactccgtatgtggatgtggcccccattggccagtgacccaatatatggaaacctaactgcatccaccattccaccgtcatcctcgccgtccccttcttctgcgccgccgccgccgccgccgccgccgccggagggcggtgccgcccctctcttcctctctcgtcaacgcagcagcaaaagctagcgtgcgccgccggcacgcaa

SEQ ID NO: 109542 - DNA, 1090 bp, Oryza sativa
ttcctgcagcccgatttagatcacttggcactgatcaatggaagtatactaactaattcctgaaacagccacatgcataatgttgtgatggttatatgcactgcgtagtgtgtaagacaacttgttttcttgatgttactattgctatatacaataatttcgttgttgtttcattttttgctacctcttaccagttctgtgtatgtgttacaacgttacactttcaaattttacagctatttagttaaacacttatttatattcattttcttcttttacatctctttaagtgaattttcatattatgccctgaaatcccaacttcaatctgaatacagctatttttcttggtctatgcaatgactctgcactggctcaggatgattcagctggtctaggagctacaagaaatgagcaaactgaggaaaacgctacaggtttacagcgaatcgaagatggctcagtggtctcaaatgaacacactgtcaaatggagaatcttcactgataatgctcgagattttttactgaaagcaagtaactcataacctgtagatttattcaaaccaccttttgtctctaacttacttttatactgttttaccgtttattctaagcaatagatctttctaaagaacagaacagcaatcctattagatatatataacagaacaacaatcctattgtatagtccagaaggtggttgatttttcagtgaatcaatttgtactcgttccacactttccggtcacctgctgatactgccagtaggatgacatcatcagaaaccttggatatgcacttctagttttcctattaagctatttatcgcttcacatatgtattccacaaccataatgttaggaaaataatttgcttttgctcgagagcttggttcagcacttccttccctgacagggaacttatgtgtttattattggatggggagaacaaggataacttgtatccatgtgccggaccttcattctgcatttctgcttggtggagaacctaccaagcatataacatggatctcctatcctgcggaaaggaaaaagaatttcacattcttcctttcaggatgggaggat

SEQ ID NO: 109543 - DNA, 846 bp, Oryza sativa
gttctcaatgagttcctgtatcggtcacttcctttggttggttagctgctcctaggagtaatctgttgcgcgtcgctttttgtgatgcctttttctttctagagggttccttcttcgtggaccgctttgttgtacgtatttctgcttcttaatgaaatgaagcattttcgagaaaaaaaaatgaagaactgggagggaaaatctagtgccaactaaaaatagtggcatatagtcaatggaattccacctgtttggtgaataatgttgttttggtgttgtgaccttttcctaaatatgcgataataatatcttatgttgaatcgcggtgttaaatgaattccatatgcaaaatattctatacgtagcaaacagaatatcagagtgaggtacatgtttaaaacttcaaacggcttcttcaaatcaagaattagtgagggcatctttctttttgtagtaagcaactctattgaagataacataaaattgtaaaaacagggtattgtagttagttattttaattcttctacttattctgtactggaaactatatgatgtggttgatagctgttatacttgactgtgagtgctgtacaagaaaaaaaatcaattagatttgatgtagcgaatacacatataaaatttgatttgatattaacctttattttgggtattttgaaccaatcaacctcaaatttcagtgataacattgtttcttatcttactcttttggactactaggtaatcttcgaaggtgtctatgctttgcatcctgctataaggaaatcactggatttatggattgcagttgtaagattttttaccctcaaaaaaaagttgtaagatttt

SEQ ID NO: 109544 - DNA, 3661 bp, Oryza sativa
atatcttcatgatatgttgaccgctgacaaacggttctttggctttggcaatgggagcaagagcaggacgtgttagtgacagtgttgaggatggcctctctccatcgaactccctccggcgtcaaatccaagtcagcttcgattccttgcctcctctgctgccatcgtccgaccatgccgctacttggccttgtcgacgccaaaaggtgttaatggccgggaagtccaacctgttcctcttccccttcccctcactttgctctcaccatcaacaccgacacaccaccagctgttgacctcatggtttcacccactgccagtccgccgcctcaccactcgcccttgttctcctccaaccaccgtatcgccgcctcctagaccatccctctaagcctgatcctcacctccccatcccagcatcacccttctcccaaacccacccctgaaccctaacctgagcatttatcataacgttgtcaggacatgttcacgagatgcccatatcgcatacgtccgtagcttaggctttctgagataggtgcaccacatatatgtagagctagtcacttgtgtaggcttgtagttatatactagctcgttgctggtcgttgtctgaatgtgtccctaactcactaataacatatttctttatcaaacgaactgaaagacctagtattatattgtgattccattttacagtgcccttacatcggtaggccttcagcttataacatatagccaaatttgaattttataattaatctagaaacttttcatctatccctttctattttctagccttgatttttgggtgttacgagtaagagtgtaagtgtatggaaatctttgccctcggatgatttttgttgcttcgttaatttttatcaacttataatcaataggagctacgtgaggtaattgtattggttttgttaaaaaaatattagcatcctggtagctacactggaacataattataatgttgcccatatttccaacacgctaacacaaaagtactgagtggtaacaattatacaagatcgtgtgtactaatcgatagattgtggctcatttaacgagccagatgggggataacttcagaactcataagtcatggagaatactcacataaccgggtctatctacaaagcgcggtttctttgatcaatcgacataaactgcataaaaagcttgggcttcgagaaagtgtgaactctttgattgactaatcgtgcaaaacagagtttgggcatatgatatattggcaatccgttgttagccaaatagcacttactaatgttgggatacacataggctacaatagtataaatcaaaatttttttaccatgtaaaccaggaaccaagcaagtataaaatcatgaatcgttaccactcgacacgttgtgcagtggaagtaggtgctaataagccgaaggaacattggcgacgtagcgtgcgtcaatgttgaggaagtagtcgatcgcagcagcccgaccttctgctcctcgtgcgttcgcctcactgtgctaccacgccaattagcaccgcaaaccagcggcgcctctacaggtatccacacgtccatggatggaacgccatgcgcggacgtgctagcgcccgcgtgtggctagggtttggctcgagagaagagtgacggctagggtttctcacagaacaccagtcacatcacctcaagaatatatagaatccataactgggccttcgaggcccataagagtcctactcagattcctatccgaattgagcacatattgaatctttatccaatccccttattccgacccgttaagtgtgcgaccccatagattcatgtacactcggctgcaacccgaaaactccttttcggtccacatgtcaacagcggctactagcagaatatattgacccatcagacatacataaagatcatatcggctgaacctctagtgtacacttgtatgaacccttttgcctcatgatatcgattaggcttaaggctagatatgtgccatcctttaatagctcaatcattcactcgatcttgtgatagattatttaacctgtgattgactcctcaataatttttggcatgatcatatatttccataatctataacatcgagggacccatgatatcttttcatagaagaggcaaatcccatcatgattattcatatcccactacatgtttcatagcataccaaaagattacttttataactactcaatcacagagtagcatttggcagcccctaagtaagctactgcatatgttgggaatcatgataatcttaggactaaaggattctacaccaacactaaatgagatcaccgatggcacgtcatatataacttttacagtgtctcatgttgggtctatccaacaacatgttccctaacatgtgtccacattattaatttggtatctccataccatgattcatgatacatgatcgtcaatcaatacacgtgctgatcattaaaccatatttgttccatatatgatatttgatcaaggatcctttagaaatagcaacatacaacataaagagtcttatgaacaaataacatattcattaaccaataatgagttatatatttcaaggaacaatgtatgataaatatgtaaacatattatgtgatacaatcatctctataattgcctttaggacatatcaccaacaactgcctcctcagccgatacaccccgaagacatcgttccacctgcttgcaaaatgccgatatacgagaagagtgtggtccctcttatttgcatagaccacacatgaatagctacatccggtaacgtggagcgcaaccaacacggtgcacgagtgatggtttcttagtggcatctacataagggttgccaaaaaagagtatgtatgcttatcctgttgactataagaaaattttggaaggagaaaaaactagagagtttttctttttttaagggaaacaagcacgagagtgtgcaattttcattaaatatagcgggagaaaaatacagcccttaagggcaagaaaaggtaaaagctaaaggaagaaaatctatacactatacaaggtgtggtataagcccacgtaggtattttgccaccaccagaaaccaaagagtttttcagcccaaagaaataccggcactgttttcgctcacgaaaatcaaggagataaagacttggactctagcaggggcaaaacgtctgtctaagttcgttccttatgagagctactatacgtacgatattccacgtacgaagctcatacgaagtaatgtttttaacggaaaccagtcatgttgtccagccgtttcctagcgatgcaacgagtaacgttcgccaccgtcagcaatcatacgagagtcgtacataacagtcgtatgcatagtattttcacactactagaaaaagcattttttccaacgtgagggccttattttcacaggcggacatgacccttagagccaaatgactgtctataaaaatataaattcgggtgaaatttgatgcccgcttgattttcgcaggcggaccacttaagcggcgcctgcgaaaatcgcaggcaccatcgcaggcgccacttaagtggtccacctgcgaaaatagacttgaatataaatagacttgcgggccctaatttttttctaagtcctcacactct

SEQ ID NO: 109545 - DNA, 783 bp, Oryza sativa
agtcttcatcctaaaataatataggtcgtcaatctcacttattagtaatatgacaaaaaacacatcaccctcaaaatcctagatgtttttcgtttcgggagggtcaataactggctatggttccacaatattcacaaagggtaaatatctggtgatagttcaacaagattcggacatatgtttgtctcattgtccattttccatggatgtttggacggattatggcaaacacttatagcatgaataaaatattaaattacctctatttttaatatatgataccattgactttttaataattttttgactatttgttttattaaaaattttctgcaaacataaaagacctttaatataaattaagtcacaacaaaattaatggcaatcacatatctttttttcacataccttttttaaataaaataatttgtcagacatattttaaaagttaatgacgttatatattaaaaaacggaggtagtatattataaactaaaaatagcttagaacaagttatttaagcaatgctagcattttttttgcggaaattgtacttagtatggcaaaaataatttaacataatccgtcaaacatattctaaagaccgtaccttcgtggtccccaaagaaacataaatcttttacttttctgcgatacaagtaaagcatgttttatatttgagtaaaatatatggccggtccttaaacttgttgtgtggtgtcacttaggtctgtaaacttaaaaatttcacgtttaggttcgtgaacttggtttaatgtaccc

SEQ ID NO: 109546 - DNA, 2276 bp, Oryza sativa
tagtgcacagatttagagcttgtttgctaaaatttggcagttaaaattgccgaaacagcagaaggtctccaatttcttttaattataaaccgagggaaagtagtttgaaccaagttgtgttttcattggaaggaatataagagttttttatacagtagtatatttcgggccatgcatgttgttcgtttttgttcttatgcacttttctgttatcttaaatttgtttgaatgctgaaatgcctcgttgacatgcagggctgaatggcaaaccagcgccatcggagtttgttttcactggaagccatattaccacaccagcaatcaatagaactgtctatcagccttcagctgttcctagtacttccttaagaaatgtggggcttccaagtggatatagccatctatggactgcttgtaattctctggatactgaccaacaccaagaggtccagcaagagcagactaaagttaatgaggagtttgtcaacactagagctgaagccaacatgttttcaaggattcaacgttccaggtcaaggcaaaggaatatcgaagaccgcttacgtgaaagggatgaagctgcaaatggtggaagtagtgatggtttgcaagacaggatggagaggtctaagattgctggcgtgcggctaaacaggaccaccacatcatcatcctctgaaccatgtggtggtgatgcaaacaattctggagcaacacacccttttcgaggtcaggagaatgatatttataccaacaagaggaactcagttgaattcttaaagtgcagtaaagagggtggtcttggaagtggagttcacttagattgttccccatctctggttctagaaaacaagattgttagttctgacagtctcttcaaggttcctaatgactgctccgctagagattcatcaagaacacaagttgcagatagcgtgtgccatcccctccctgaaactcatctatttgttgagcccaaaattcttcaatttgaaggtgttgaatcagtatgcatgaatttttcaagtgaaaaaatggggcagccactggaaagtgcccatcttgatcttgctgaggcacatcctttaaatgaagacccatcttctactggctgttatcatgtaccttgttccgtgggaagctcattggttgatggtgttgaattgggacttttaagcactgacagtgcaacattgaagcagcaccttcaatgtggcagtcctgatcttagtcccacacattctcgaaacaaggacccgtgtccaaccatttcctctgaagtacctaattacacgagtgaaccattagttgagcaggatacatattgtaatcctgaaatcaattctctggaaggaccatgttctaaggtcagccaactgcttgaaaaggaagaaacgaaggcatgccccgatgccaatccactgcttaaaacagatgcattgcataccataggaagcaccgaaagaataagaaatcttgcctctcggaactccactcctcttgaacaacggagctctgatcctcatgtcttgccttgtcaacgcagtagatctgtgcaaccagctgacagtagttctcggcctcctctatcaacaggaatattgccggacagtttgttggaagcggttggtttagaccaccttccgcattcaaatgatacaaatagccaatgctccccatctaggtctgctgcaagcccagatctgcttccacttcgactcgttaattctggtgatgtttatcaaccgagcttctcttgttgtaaatcacaaaataacaaagattccaatggttgtgctgttgagggcaccactgtatccatagagaaaccgccgtcccaggagcaatatttattggatagaccacctatggaactcaatggttttgcagatgaggatactcccttgggccacactctgggtacacataatgagatgctgaaaggaaagaaggcagacgacttggtgaactgccattctggaaagctcaacagttctcagaaaaaacccaagggtttgactgaagcatctggtttttcttccggaaagaatgagtctgcagggcaaaaggttgaaagcaatatttcaactggtgtgatgcacacaacagaaaggagcagggggttttgtgccatgaactgcacggaagatctccaacaagatggtactgcgcttattacttgtaggaattatcttaatttgtcttttgtagcaactgccactctggcacgtgcttacatagtttctaatcttgcaggaacagaacaagaaacctct

SEQ ID NO: 109547 - DNA, 2736 bp, Oryza sativa
aattttttgaataagacgaatggtcaaacatgtgataaaaagtcaatggcgtcatctattaaaaaacggaggtagtataaaactttatagcattgctcatattttaatgaatctagacacaccacacgataatattgtatatcgtcaagtgtggccttcgttcttccacgtcgcgtgatcatttcatctggtgcctccatcctatttccatggagcgaataaaatcataaatgacagttctcatatgatgtacattgtacagtatgtgatgctgcctttgtcctttggctgaacgcgtgcagccgcatgtgcacgtgtagcaaagctatttttactttcttatttttgaaaactagatgaagatatgtgcctagatctgcatggaaaatgatgaattatggtactagaagaatattatgtcctcatcgtcacagaaacaaccggaggtgtgctgataccggtgggtacataaatccatcccgagtttaaatcctagctcctagaaacatgcttcaatagaaatttagtactaactccgtcccataaaaattaaatatgtactccctccgtttcacaatgtaagttattctagtatttctcatattcatattgatgtcaatgaatctagacatatatatctatctaaattcattaacatcaatatgaatatgggaaatgctagaatgacttacattgtgaaacggagaaagcaggaaattaaagataaattaggaggatagactataataaccttatttaataaacatagtgcatgcacgcatttcatatataagattgattaaaaagaaggttgagacaacggattagagatgagatggaagaaaggaagatttcaagaaaatgtaatcaatttgatgggtcctatattagtagaaataagatttttatgcgacaaatgtttaaaggcagaaatttaatttttacgggactgaggtagtaggattagagtatgtattgacagagtatgcttagccacttaatccctccgtcccaaaaaaagacaaaccctgggtttccgtatccaactttgactgttcgtcttatataaaatttttttataattcatattttcattgttgttagatgataaaacatgattaatattttatgcgtgacttgtctttttaattttttttcatattttttttaaataaaacgaacggtcaaacgttggacacggaaaccagggtttgtctttcttcggacggagggagtaggtactagctccattctaaaatattaaaatataagatatattgtcttacatagttatatggataaaatctcctatattttagaacgaaggtagtatgtgcacatgacttacatgtatatggtaaattggtaatgactaaaaagagaaaagaatattagtcatcagaactcaagtcacggatggaccatatagctagctagtgattggcgagtcaatccaatcctctatggattatatatataaagtgcacgtaaagttaattcaccatggcatttgattatagtgctatttgacactcgagttagcagccggccggggccgggcgatcacctttgtttgacgaataaatttttttaaaaaaaactaatgtgcacttttagtttgatatagattccactttttgtacattaattacttgctgttggtacaacgttgacagcgtcgtccaagaggaagaggaaattgtggaaccttttcttgtcgtctttcaattaattagtgcgtgtatgattcatgaaagttaacgtcattacatgtccttccaattaatctgtgaatgtgcaatattatattgatggtgctattatttttgaagcacatgggctggtgggaatatttctcagaggttaagtttttatcttttcttagaggagttttaaccatatcggtaggggttttgggtagattgtatatatggtatggagatctcaaacatatatattcaactcaagtttggattatgacaaatatacttgacacatgtgctcgtatttacgacgaagtgagtgtacctcaactggttagatgcttgtggtggaaccaacccacctagatttaaatcgtagatttaacatagtgcccgcatttatggctagttttttctcagaggtagcagacgtagaaaggcagggtgagtgtgcgcgcgttgtgagcttctgtgtttgtactatgtttctagaaagcaaacatacttaaaatataaagagtaaaatacatggccgctaaacttgtgttgcggtgtcacttagatccgtgaacttgaaaattgcacgctcagtgaacttggtttaatgtaccaccctggtccaaacgtcctttgactgcgtttgaccgccaacgtgacatcccacataggcaacacttttactctcagccccctccacattacaacacgtcgcatatatctccttatagctatatagtgacaccagaatcaaaaaaaaatcctcaaatagttcttcctcctcatttttctccttgcatatataaaaaatgtggtcttgattagcaattgccatttgctctgcgctccaaaataaccttatccttgcgcaacgggcacttcatcaacaacaccttcttccggcgacttcaagacggggacgagcttggagaatcaatggggatgcctagcgtgcaagacgcattgcgctgcctcccgccgctaatccggccgcactgtgcactgcgctgcctcctaccgctattctcaccgccga

SEQ ID NO: 109548 - DNA, 1637 bp, Oryza sativa
atcataacgttattatgaaagtgtggtaaatattataagttttgtagtaaaaaatcgtcttactgcaattcttgaatagtgctactgcataaacttgtggtaacgtgtatctaccatgcagtaacacttacacttttgtgcagtaacaaaaatatggttagcatgtagacttttaactcatatatttttgtttcaattcctagtttactataatttcaccacgatgttactatcaaaagtgcagtaacatcctatatgttttgtagtaatgtgatgtgttactatacttatacgataatgttactactaaaacatagtaacttgttatgagttttgtaataacatatatatttctcttctacttagcttcctacaactatggaactttgtgtgtcctgtagagttgtaatagtttatgtgcttttacagtaatcgagtgtgttactactatttcttctcgaagattggtcttttgaaatttatctctccataagtagtaatactaaatcattattgttactactttttatggtgtgttactactattccatcatgacgttactatatgtgtgcagtaacaactataatttttacagtaacatgtgttactgcaatttcttaatagcgttactgcaataacaggtggtaacaaccaaacacaggtacaagacctaccacccactttgaactagtaaaatgtaagtgaaagtgatatcttttgaattcacatctttaaacaataatatctctcacaccacatattatatttttgaaccttttgcaccataatgctttaaaaaaagagctctacaaaactagatccgtcaagactatattttaactatattttattagtgttactgcaagtaagctacagcgttactgcatggtggtcgtcatgttactgcacagttcgcacgagacgaggacaacaaataggtagacgtgggaggaagttagcacactggtttgaccgacatggcagcgatttgaccgtcctttgaccatgctttgactgggatgggaggtgggttatgagcccaataaaaggatgcggaggtgggttgggctcttgagggggagggcggtattattctataccccgggtgtagaatatatatatatatgtatatatatatatatgtatgtatgtatgtatgtatgtatgtgtatatatatatatatatatatatatatatatatatatatatatatatatatatatatatatatatatatatatatatatatgctaagtctaacaatcttatattaaatctctaataatataataatcttatattaaaactctaataatctaataatcttatattaaaactctaataatcttatattaaatctctaacaatcacttctttacatcacttgcctgcgcgaattcctttgatggctagctaccactcggcttgagggacgacgacgacatcttctctgcaacattactaggaaaatgtattagtctaaacgggccaagttacatatgttgtatttcacgttttaacctatatatataatcatatatgtatgctaagtttaataatcgtttaattatctcgttcgtacacgtttcgctcgcgttcgttcacatacttttagtacaagtgcattcacgttcg

SEQ ID NO: 109549 - DNA, 757 bp, Oryza sativa
cattcccctccgtccgatccgatgggaggggaggcgacgggcggcggtggcaggcggcggagcccgatggattgttttttttatgtttttgtagattcttttagatgtttttgtgatttgtggatgattttgttattgaatatgtttcaatctgtgatatgtggggatttggggatttcaaacaacgatgattgtaaaccggggatttggagatgtggggaactggggcatgacgcagtgacggtgattgtgagttccggctcgatttgagccggctcttttttttggctcgtgcaaacctctaggtgccggttctatttttggtagggaccacctatacatttgtcaataaattttcttctaaaaatttgacagttataattttagtacaatcttagtgtaattactgtgtaacttgtatgtaattacgctgtaacttacatgtaactatattgtaacttgtatataagtttcacgcaattttgaatcgttagatctattataagatttgttctggtgaggaagaagaaaaatcacagcacacgcatatgtgaaaggacttgttcccacgacttccattttaccgaaataacatattacggagagatttttaaaagttacatatatgttacattatagttatagtgtaattacatgcaagttatagtgtaattacactacgattgtactataattacatctgtcaaatttttgggagaaaatttgtcgataaatatatagcaaaaggaaaaagtac

SEQ ID NO: 109550 - DNA, 799 bp, Oryza sativa
gggcaaacgaaagaggaggagtagggggtcctatttatagccatgggaggccgggatagagcccacaaagacgggaaaatctcaggaaagtttagatattcgcgggaaaaaggaaaggttgaaccgcgaaattggaaaggatttccatataaacttttggggatttcttggggacaaggaagaggagattgagaggattccattcccgcaaccaattcggaaaaaggagcaacgatgaggttggattttggaaggggatcggcggcaacaggcacggcacggctcggctatggctctggctctgtccagagctggaagatgaacagtagcgcagggagagaaagtagacttctttccgggcttttcttttctcagcctgattagaagagggagcaaaacaggactttggctgagagaagaagagaggatgcaggctcgggttgggccggcggaagagagaggaaggaaaggaatgggccgattcagcctaagacaagggaggagaattttattactttcccaattaaaataatcacttaaatgatctttgaattgttaaaaatacttccaatgctcaaataatttcaagaaaaatcctgaaaatacttggacactcaaagtacttaacaaaattacaattagaccatttaatgattagtttaatatgtgggtaattactgaaatgctctttgtatgattaaaaattacgaattgagctccgaaaaatcccagaatattccagagagtataattaaccatggagaatttaataaaaattaaatccatccatgctttatat

SEQ ID NO: 109551 - DNA, 686 bp, Oryza sativa
ctctaagaggttttcatcatcttgtttagatcttacagttatctttatgcttaatgctacatcggttgagttcgatctattaagttctatctataattgtgatatctagcctggtttatgatcatcaatagagatgtatcggagttccagccgatcttacctgatttagctattttatcctcatgcacttgactgatatgttaaatatgccctttatattaagatctcgttgcgttaaagttatattaggtttattatttgatatatcttgcttgtctcgatatcttgatatagagtggtatcggagtattagccgatacatgctaggtctatttgatcggctatgctataaacttctatataattcatgttttaatatatatttcgatttaagtgatttatattgtctcggcatggcgaccgatctatcccaattacttagtttaagtatatatcgaagtaaagattatatgttgttaatatctacagctgatcgagtagatttagttttattttatttactcattactgccgaccgatttaaatttgacatcggcttgaagataaatgatatgtcatcgataactagcctctcggctattatttatagatttaaccgcggtttttcttctctttattcttgttgattgcagcatcaaatcaactggcatgctcacgaacctaaa

SEQ ID NO: 109552 - DNA, 1470 bp, Oryza sativa
gtgtagggcccaccgtcggacatgaaaaacactaatgaaacaaaggtgccggttttgggttgagaaccgacacctttgtctcaaaacaggcacctatgtgtggggcctgccaacggctagtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataagataaacggcgcagacggctccactccacaggcagcttgaccaaggctacacctaatcctccacaccattagcctcattgtagatctcttcctctgatgaatgattgcaaggtgagtatatgacatactcagcaagccacgcagcaaatatgcaagtgcacaggataacaaaggatggcatagtagggtttcatttgcaaaagcagcatttagcaaacatttcagaatttaataaaacagttaagtaataattaaacaatattaatccaacgctatacaacataccctgttgtataggcccaaccattctgaacaaccatcccggctgcacagttctatctccaaaccaggaatataccattccaaaccaggagctaatcaaattattaccagttatagcatcatctactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagtgacccccgtgggcttatctccgccacttcttagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcattaagtaatagtgagtcataagttatcccaatagtgagctaatgtttctaagcagggctaagctattatacctaatatctagttgaaccaatataaataaagctcacctagtcaaattataataacccaaggtatcaaggaataaagtaatcaagaacaaaagggctataacaaacaataggttaattccacccaatgacattcgaaaata

SEQ ID NO: 109553 - DNA, 627 bp, Oryza sativa
ccttggtctcaaaatatatgagatcatacttgtcccaagtcaaaaataaatttcaccaaatttatagaaaataataacatacttacaatatcaaataagcataattagatccattattaaaaaatcataggttacttatttgatgtagtaaatgttaatactcttgttaaaaaactttatcaaactttgataagttaaatttagaacaatcctatgatccttatattttaggatcaggggagattatgcaaaggatcttattggtcaaagcaagacaattaaagtcaaaactacagtaacaattatctttggtgcctggtataccacgggatcctgttcgtacaagacgatgcaaatttggtatcagattatctgcacaatatctggtaccccataggtaccgggcattaatacatgtcaagtacaaaactgatacctcgttggtctcggtcattacctaacaatatcgcgccagtacacatcaatatcagtcgaaacttattggatatcagatctgagctaagaggagtgagagaagaattaagggatagagatggttacctgtgcaacggcacaccccatcctccatcagcatggcggcgcttcccggcggcggttcgagggggt

SEQ ID NO: 109554 - DNA, 912 bp, Oryza sativa
caaaggtgccggttctcgatccaaaaccggcacctttaatattctccctcctgcactagccgttggtgggccccacacataggtgtcggttttttgtatgacaagacaaaggtgccggtttttggtctagaaccggcacctttcttctaatagcacttttcatgccctacacaaaggtgccggttgggaatagaaaggtgccggttttaggtctagaaccggcacctttgttccaatagtgcttttcataccccacacaaaggtgccggttttttgtctataatcggcacctttcttccaatagggcttttcatgccctacataaaggtgccggtttgggaagacaaagatgccggttttgggtctagaaccggcacctttgttccgacagcagtacttatactccatcccttgctactcgagctgattgagcaagaagagagtggcgcctctccttcttgcccaatcagctcgaggaggggaggaggttttgctctattttttttggtatttggttaaagattgaagcctaaaggtaaatattcattatttctccctccgtttaactcttcgttgttgatttgaattgtcgtgtgcgtatgcatgtaaaatacgatatgggtgttatttttagggataattctttttatcttttttgtgtctattgttggatgaaatgctaaatttgtgttaatgttttcttccacctacgtcatggccgttactcaaattaatggttgtcaaactatgttaaggccacgaaaatatccattgatagcttgatttatctcaaatttatgttaggggtgcccatcgattcacacccgctcattgaattgaattgccatgtggtaataccatgtaaaatgcactagtcattaatttgtatggatccataagtcattcgtagat

SEQ ID NO: 109555 - DNA, 699 bp, Oryza sativa
ttgactttatccatcgaaaacgtcactactgaaagaaaccatttttggttgattgccaaaaacaacaatagtcccggttgcttaaaaaatcgggactaaaaagcatttttagtcccggtttaaaagtgcaatgatctttagtcccgattagtgttaccaaccaggactaaagattatcttttgttccggtttattcattggcacgacatggcaggtctcctaatatttttaatcccggttggtataaacaacctggacttaaaaatcagattttcagtcccggttgtttataccaaccgggactacaaatcagtttcccatgtctctcttccatcattctctctgcgcgcatctgagtcctcacccttatctcttcctcccctccactctttatctctcccttatctcttcctcaccttcctctttcactctcatctctccctctccccttcctcttccacatctgagttttcctctcttccgttcctcagatatgcgggagaagcagccggcggcagctgggcccgtgcaggggaggggcggcggcggccaggcctgtgctgggcaggggcggcagctgccgtatctaggcgcctgccgggtggggcggcggcggccaggcccatgccggaacgatggcgactaggtggtggcggagcgacggcggcccggcgccgaaggccgcgcggcggccggctc

SEQ ID NO: 109556 - DNA, 1494 bp, Oryza sativa
ctcacgcattaaaacgtaaaagaatatataaattcaacagaagatatcctgcattaaatttgaacgaaaaatatgcacgagaagatatcctctcgaagaattaaaattttcccgttacacaatagatgtatacacacggatgtggattttcatccctcgaggggacattcactcgttgtttgcatgtcatctaaatagtcataaaacaatttaaaaacaaatgacaacatagattaatacgaaatatatcactccataaacatgcaaaaccaaattcaacttctacaagttgcaacaaaaataacaaattaatcatcccatgcaactaggaggggtgtaaccgtgggactatgttgtgcgtatgtgcatggcataatggacatggattttcatccgtcaaagggatatcttctcgctgcttgcatgtcatctaaatagttattaaaaaaatttaaaaaaaatgataatatagattaatatgaaatatattactacacaaacatgcaaggccaaattagatttctacaagttgcaacaaaaagaacaaattaaactgaaaatagttcccgtacttttgcagttatatttgttatttttgttttaatatgtagaagttgaattctaacaaatatgtttgtggagtgatatatttctaatctatattgtgaatttttttcgaatttttctataactatttaggtgacatgcacgaaacaatggatgaaaacacttatccattaataactttaattttctattgggaatgagctaagctttattttgcatgactattatttacatttaaaaataaagggccaattttggatgagctcaaggaccatagagcaccctgagttcgaaattactgaaggctattaccataggtctgggttaaaaggttattgaaattctataaaatttacatctcgtcatttaaaagaaattaaacatgatttcgtagataagtctagagctcaagcaagattcaatagtatagttagctataaaaattgacaccttatttttaactaatttaatagctcactcgtaaactacataaattaatttaattgctcactcataatagattctgtgatatgcatcttccattttatattctattactatatgaaatatttcctgcacaactagtttgacaataattcatgttttaggatttgtttgctgctggaagtgacacaagccctagcatagttgaatgggcaatagcagaattgatgagaaatccattgtgtatgattagagcttgcactggtggagaaaccatctttcgtcggtcggccgatttccacaatagtcccggatgcaataaaaaccggggctaaagatgatctttagtcccggttcaaaagagtaatgggcatatttgatctttagtcccggtttgtgttaccaaccgggactaaagatcatctttagtcccggttcgaatgctgtcaggacctgtcaggcccccccgggatctttagtccc

SEQ ID NO: 109557 - DNA, 695 bp, Oryza sativa
aatatacaaatccatcataataactaaaccgatatatacttacttaagaggcacttagtcctcaccatgaagaaaactgcagcggaaaataaaatctagcgaagctctggctccactcccacaggcagctcaactggggtataagccaaacgtcttctccttctggatccttcttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaattagagattttaatcaacactgaacagcacacccatgctgcacaggcccaaccatcctgaacaaccatacccggctgtacagatctaatctccaaaccaggagctaagcaaattattaccaggtataacatccaaaattattgtgagaggtgtgagactaattacgaaaaacattgctcaacccgcccataaccgcgggcacggctattcgaatagttttactctggccagaggtgtaccactgtacccacaagacacagccccacaacatgtcaccatgtgcctcagtaccaccacggtacctcggaaaggagctgtgacattacccctcgcataacacaacccacca

SEQ ID NO: 109558 - DNA, 738 bp, Oryza sativa
tcttatattaaaattgtagtaatcatatatgctaagtctaacaatcttatattaaaactctaataatcttatattaaaattataataatcatatgctaagtctaacaattttaaattaaatcgctactaatcttatattaaaattgtaataatcatatatatatatatatatatatatatatatatatatatatatatatatatatatatatatgctaagtctaacaatcttatattaaatcgctactaatcttatattaaaattgtaataatcatatatgctaagtctaacaatcttatattaaatctctactaatcttatattaaatctctactaatcttatattaaaattgtaataatcatatatgctaattctaacaatcttatattcaaactctaataatcttatattaaaattgtaataatcatatatgctaagtctaacaatcttatattcaaactctaataatcttatattaaaattgtaataatcatatatgctaagtctaacaatcttatattaaatcactactaatctttgtcacgcccggaaatgtcacgcccggaaattcactagtaatttccgaccttatttgtgcataaaatcctcgtccaggaatcagccgaggtacacaaactgacaatttaatatacaaatccatcataataataacgttacacacttacaaaagaaaagaaaccagcagcggaataacggtctagcgatggcttcagct

SEQ ID NO: 109559 - DNA, 1157 bp, Oryza sativa
attcctgcagccctggccgattttgtaataaagataaagcctttacccatggttacccagcttctattgaataaattattgttaaacccgtgggaccaaaaacccaccaattggggaagggctttccggcccaaactgctgatcagaccgggccagataaggccactgccggtcagaccggccagatctggccgggtttcaccccggcggtcagaccgggactcaggccggtctcaccgcgcctatggacgccggtcagaccgggctctggaccggtcaaatcggcacaatagtgccgattcaggggatagattcaatgactaatgttagttatttgtattatcttagaacatttggtcctcctgtatctactgctgcaagtaatccccaagttcccccacatgttcctaatgcttataatgatgtttctagggggtatcctcctgatactaggcaaggccaatataatcatattgcgccacaacatcaacctattaggccaccaaatccaccaccaaatcaacataggccctgataatatagagcacttgattagtggaattattagggataaattcaggattgaagctaggaattgtgctaaggtttaccaaaagccgtatcttgattactatgataatgtgccatatcctcgtaattatagggttcccgaatttaccaaatttagtggtgaggatagtaggactacatgggagcatgtaggtcaatttttagagcaatgtggagaggctaatagtgatacttttaaattgcgcttattttctttgtctttgtccggtactgcttttacatggtttacttctttaccgacaaattctattcatacttaggctcaattagaatagatatttcatgattatttctatactggtgaaattgagcttaggttatctgatttaacatcggttaagcaaaagtataatgaacctatcattgattatgttaagagatttagagatgttagaaaccgatgttatagcttgaacataactgatagagatttggctgatcttgcttttaatggtttaattactcctattaaagagagattagatggccaacaatttattgatgttagtcaactcatgcaaaaggctctggctcaggaaagccgggttaaggataataaaaaatct

SEQ ID NO: 109560 - DNA, 2076 bp, Oryza sativa
gaaaataagaaccaagaaagcaaattaaaggcagaacagtcaaagcgagcgcgccaactctttttgaacgccggaaaaaagaaacaaaaaccagcacaaaaggtgaaggaggaagatgaactcattcctcaatcctccagcgtttacctgtcgctgaaatgggggcgaccctgcaaatctctgaagaccaggatgatattcagatttgtccatacaaactattatattgtttttgtaaaaaaaaatcagattaactgttgaattagattgtggtggtttcaactttcaggtgtggagtcaagaacaagtcatgtgaatgcaaagtgcccaaaaagcctagatttgaagtcacataggacacctatcctgagcactaactgaaatctgttgtcacttgatgcataagatttgtgtacccatgacagccaacaatggctggataatgttagacatattggttgacatcacaccaggccacgaattcctaatccctaatccttcttccttttagtgccaaagttggtgtaggagcagtaaacagcaacatgagtatgtcctaagaattcagaggtactgtagaaatgattaacatatcttcatttattttactgttctactaacttgtattagctcaaattaatgcctagcaatcctttgatgggttttgcaaaaattaaaaaaaaacgtactttttttctgtccaaactatagttgttgtaggacaatagtttataaacttttcctatgtgcgacatgattattattttgaaggtgattggaggttacaaaaaaaactttctcatgcagtagctttcagtgtgaacagtaagagaacttacacatgacatcttccatctagaagtgcaggtatcatgaagaaaaaaaaggacatggcaacaaatccatttatttcagccaaaatagattatgtaagcagcagccagccatctctctgcaatctagataagaaaagagaaaaagaaagaaaattaaagttgaggtgacaagtgcacataaaagtcttttaaacgtctaggtatgaaattatgtgatcctttcgcatcttccaaactccaatccgtctcatctgctcctcctcacatcattttcggttttcctgtgagcgatgcaaagtctactctggtgtgggcatgtgtggagactcagagaccacgattctcactgcaaatatatcattttctttctctctttttttttcaccaccgttcaactctctctttttgacacaacagcgatctccctgtcgtgttgtcaacttgtcatttaggaatatgtgtgtgtgtttttcttactggatttcacctatatattttgttcattatgatctgtactttttccatgttatcaatttgaaggtagccagggtttttgggattcactgatcttacttaccatctgagtgcacactcacaagaaccataaaaaggcccttgcatgatgcgtcttccatgtaatcgaaaaaaatagctcctgcaagacgacaaaccatttagttacccatactcttttcgtacatggtatctccaaaccttgtcacataatatttaattcagttctagaaccggttgaccccaaaacataaaagcggcaccctccatttccatctagtggtagtcaaatacgatgaaaaatccgggtgcaggctagacttgaatttggacccggcgtacatatctacatacaatttggtcaatactctcaatcttttccatgaaaaaaatcaaaacttgtccaactcatgacgacatagaagctgcatctgatggtcacattcagctggctgggtctggaagtacaaccgctgggccagtgttgatttcttggcacaccaaagccaaagaaggccacaaggttatcttcaaagtctcaagtctagtcttgttccatatgaacacttgccctgtttgtcatttctcttttttttttctcacttgatgcaaatgttgcaacatcatcaagatgttgaggcctcacagggctccaaatgatggggcatgctggagagaaattaaaaggtaaaaaaaaaagagaggacaaacgatgatgctgatgagc

SEQ ID NO: 109561 - DNA, 667 bp, Oryza sativa
aaaaaggaatataaaatatgcatgcgatggctgcagagcatggtcaacttcacatattgactaccaatgtgtcaaacctagactttcttatgcataaagtgtgaataatttaaaacttttagaaaatttcctgaaattgtgctgcttttgaaatgttgaagaaaggagacttcgagttgctatttgttaggaaatagtgcattgtgacataggctaatcaaccatacaggatacgctttgaacaaccatcattagctgtctatcaaattaagtatatatgacttgctcggtgttctcaaaagtttccaaatggtatgggttgcatttgtcactgcagattctgaactttttgtttcacacaaactgacaagaacataattattagtttaatggaataagtaaacaacttttctttggctctacatacctgaaagaaattagtgtagagtcggttttgaatcattgagctcccgttacctgagtgccaccgtccaccaatagtccaatataatcttagtcgtaagtattcagtctactgagtaagtttgcaacagtggcctcttattccactcctgcattaaaccaccgaggagaatattactgtccaaagaaactttttttcttcttcttgtcggattagcatgcaagaaaacgtgcatattatagt

SEQ ID NO: 109562 - DNA, 891 bp, Oryza sativa
acatcaacggtgctcatcagcttccgtttaggctgtttctgtcaaacagtggttcggttcaatggcttgttgggagcatacggagctccttcctgcatgcatgctaagataaattgggtgcaaaccaataaacatgtagccaacattgttcctgtaactactaagaattgtcgaaatgcaactagaaaaaagctagtgctctggcatctcctgatagcatagcaatcaccagtaggttcatgataattttcagatccccggataggcggatacgaactgcacctggcaggctagatcaccagtaggatattgatgtagttctagaatgggggtagaagcactgcatttctccataaagattattaagcaggattttctctgaatggttacaggaaagggatgaatgcagaacagagtcgaacttcactgcaggacaaacataagttgtgtctggattctaggaaaccgttattgggctattactagcatgcaggtgtttatgccattgcaatattgcatagctaggtggttaactacaagagaggtgatagtgacactaatggcccacaatcatcatcattgtcggcagttcggcacatggcatacattacccgtccagccagacagctaatctagtggcatgaccaggattcatctggcaaggggacaataagcaaaacagatgggccatgccatttgcacatatgtaggctgcatctgaggtagttttctatatggatttcaaagcagactacgttatttaaggacttctttagaacgcagttacaaaggaatagaaattttattagttagttcccacacaaaaaacaaaatctcatccattccattccaaaggaggcctaaactagtaccccaaaaatcctagtgggg

SEQ ID NO: 109563 - DNA, 674 bp, Oryza sativa
ttgcacactctaccaaaattaaaacacaatttcttcctgcctggtctactcacattatttaaaagggaaatatgctctcaattatttgcgtgaaaagataataaaagtactacaaaatacaaatactaaaggtgctctgtacgtacaaaagcaaactgatgtactgcttacttctgaacattactctgtgagtgtgtgtctagccgcaagtttttagtgaagattgtattaattgtagcaagttaaaatcagaatttcattgttaattagctggtatttgcaccaaataataatatagtctggttaaaccagagatgcaattttaaaaagaaggtagttgaaggggaagactaaccaaataggctgcttaatgctgcaacactaagggagattagtacagatgaacatagtttaatttcacactctggacagtgatagtgattgtcctgacgacgatgctgatacgaaagatctattgacatatgtacatatactattcaagaataattcgcattatatatatggtagctagtctgcatgattagttattgatacagattgaaacctgcagactacggtacaacagggcctgaaacttgtactgcaataactagatttgtaaccagcagctgcagaaagggttgtctgattaatcacttcactaaactttatgg

SEQ ID NO: 109564 - DNA, 673 bp, Oryza sativa
ctcgttgcatcatcaatgaaggcaagggagaaatgacgcatttctgaaagtgctctgctttattgatccaatgatagatgaaagtacaagttatcatctataacacagttctataattgtaagcctagtagtacatcataattcataagtaccaaggttgaagaagtaccctttcttgaatcattgtgcatgttaatttgttgaaacttggttgttccctgtagtttcgtacacatgattagtcttggaaaaaacatgatcagagtcagttgctccgtaaaattcctttagaagtacacaaatcattaagcacaagtgttatctgttatttggtgcagataaacccttcatattctcatttcttcacaataataaggtcatatttcttctagagaagtagaaacgtacacataggtatgattacatttcctgcccttgcaaaagtatagaagttacatcatacattttctttttaccatccatttcagtagcagtaaaacaacaaccataatcacctaaagcttgagggagaaaggaaaaggtgttttagttcagcacgcggtaaaatggatcaggtaaattgtaacagataatgatcaaagatcatcatccagtgcatcatcttgatcaaaaggtattttaatccttcacgtggtaagagagtaaattctta

SEQ ID NO: 109565 - DNA, 623 bp, Oryza sativa
tgcagggcatgcgtgtttaattaggtaatattgacatgaccacatgtaaatttgggatgaagtgtagatccagtgcgtggacggcacgtgttgaggaggcagaagagaattaggttcgtgtggtctgacacgtgtgtcctgttaattgccatgatctaacaacaaataatcaaggagcaaattaagcaagctagctagagtatccaggaagaaggaaggaactactatacctgctcgattgatggaatggatatgatagctagatcccttgtttcacacgcacacatgcatgacacgatcaaaatacaattaagcagttggtaaacctctcacttaatttggtacatatatatatatatatatatatatatttgcatcaataacaagaagctatagctatggtcgttaggggttggggcccacccaactagctacagatgtggaattcatgtgcatatatagcttttgttcttgccattgctctaaactggtctttccttgtaaagcaatgatgacataattaacgaaacttaattgcattattatatgtgtactagctacctactactggatttttcacattttggtccttttaaaaaacatatttcgcaagtagaccccta

SEQ ID NO: 109566 - DNA, 516 bp, Oryza sativa
aaccaaaaccagaaaattgtatgaccatgaaaaggagaaaaagaaccctgccatatttggacctacttgtaatttttccttataccttttcaaattaaaagtttaatatgcagggtgcaaagacatcctgtagactgcattgtcattttttggaagctgttatgttctttttggtgcccaaacaatagttaatttcaagggtgcacaaaaaaatctgtatgcttagcatacgggcaattcttctttagttgaccacattatgttggtttctatgagaataatttgaattgattatgcgttgagttgacatgtgacagttacaactgttactttttctgaaatcgtgcaataattttcctttaatctttgctggtgtgacatgttggagtatttagcaaattccatactaggaggcatcctctctgcagatccagtcataaatagaacctttggaaatcttgtactagcttagcagttaaaaattgattgggcatgaccctgtgtccctttccatgc

SEQ ID NO: 109567 - DNA, 707 bp, Oryza sativa
tattgcactactacattcagggaagcttgctttatgctaaaaaaggatagtcaaataagttttgtcgataattcctcatttaggcaaatattagatcatgaatttcttttaggttaaagtccatttgtaaccttaaactgtgctcaaagtccatttctcatcttgcataacaccctaaaccatattttatcgtggttctaattgatatgatagtggtttttcgctagcatgaacttcagttaagtattatgattttcgacctaattaagtaccatttgcatcaacaaaatatgcagctaggaaaaccacctccatttcaaacaaaaccactaaaaaatatgtcccaaggtgtttcttgtcccattaagagttgaaggtgaaaaatatccagttttctagtgaaggtgaaaaatggccattggccaaagtttaaaggctataaatggactttacccttagtttttattctttggatgaacaaaacaccatgtcctaaagtaaccaactgtatatttatgccaaacttgagcttgactgttgatattagacgattcagtatatctttgatgcttggacatgggtatctcgtcacagcattgcacatttacaaggattcagaagtcacaaacatggtgacatgggtatatattttaataacatgataaaattaattagagcagatcttgtttagaacgttagcacaattc

SEQ ID NO: 109568 - DNA, 693 bp, Oryza sativa
attcctgcacccctttcggaagtttgggaactaaacacagcctatatatgtgcagtagaccaagtgaaaaatgcattctgttagatgttctcttcctttgtagtttcaaactttcaaaaatgcattgactaccacttctgaaactattcatcctttaatttagggacctcaaagagaaagagagagtaataattacactcgtatagtgcataaacttacatggggtgagtgaaacaatttgcaaaatgtgtttccccccttttctattttggcagagtgcatgttttagtagaacaacttaattatttagtctgtgtaaattagggctaaaattggccacacaaattaatgaactgagactattttgattggaacactcatcattccaatttataattaagttgtctaatctgggcaatttacaatccattgtgtcttggccttatatatatatttccttcatgtgggtagaaggagtactggggacagcagaggcaagctcagtgtaaggtggtcttgcaagccaacctggcatcctagctagtcagtatagaaaatcaataatttgcctcggagacatattttggccttgtttttcactgactaattacaccggaataagaattttgcatgtttttaaacgtattttcacccactgtgcaagttcaattcatacaacgtattcgtcagtat

SEQ ID NO: 109569 - DNA, 932 bp, Oryza sativa
ccccaacctagataaagatggtattgtaggcggtatcagcgacatccagggtggatagcttcggcctaagggcagatccagtgccctgacaaaaggcggatgcagtgagaaaaacaaaaagacgacgggcttgttagtggtgccagtggtgatcagtatgcagggcggctatagtgaggagcaatatcagcagcgtggtagtaggctggttagcaatgacagcaacagacaaccctagatctagggtctaagtgccatggatccaaggtgtttccgtgtttgtgcccgaactcaatgcaccaaagagttttcttcttctctacctccgctggatggcatctgagagcaaatgcactagttcttcacttctttgcctccactcgatgatgtcagcaagcgaaggaagtaagtgctgggagttttcggatctagatcaaatggatctgtccaatagtaggggtaggtttgcgaacaaaccagagagaggtgggtgaaagaggatgagggtataggagttttgactacatttcaatatttattcgatacgtttttggtacaacaaggctcatcaggcagcagaaaaccaaaactgagtattctagtattttttgttttcttttttaattttttttgttgtttattagttataagacctggaatataagtattcgtgaaacctttacatatgtatatatatactccggattccatccattatccaaaaaatctataaaaaccaaatgcttctacggttaccattattctcgttggccacaataatattaaggctagcttcaatgtttcatcttgcagagactaatcaaatagctagttggtgcaagatgtggttacttatatatgaaaacaaaacagggatccaaacggtttaagtcaaatgaacagaaactcaagaggattcctcaaacagctgc

SEQ ID NO: 109570 - DNA, 668 bp, Oryza sativa
ctgcgaagggcttaagggctactggggagattatggggccccatacccacacggcatggttatccgactagttataggagataactcatatctatgaaatatgtaacatatcatgacttgggtattacgtttccttgtatattacggaacggtctaaagtcctggtttgataagattgtaaagtagatttagtaaaccgataccgtattggttaaggtttctatcttataatcctgccctccatcctatataaggtgggcaggaggccctctagggggcatgagcacatatgatcgtcagatctatactacacccggcggattcaaattcccaaacaggagtagggtattacctctcattgagagggcctcaacttgtctaaatccttgtctccgtatccatccacttttaggtctcgtgcactaccccttttattattgccgaattcatgtttcgacagttccagacttacattatatagctgacaatgttatgtgacgcatgagttgcacaatatatatatatctttaggctaaattgtactatgaatgttgttgagagttgtttcatgattgacttcgttagcggaacgccttggcattgcaatttactttaccttctcttagcgatcaagaaggcgcatgatagataggttaacactagtttcc

SEQ ID NO: 109571 - DNA, 761 bp, Oryza sativa
ttttttttttctaaacatgtaaattataacagcaccctattctttgttcttatccattgcagcatatgtgttgcttggattaacaaaagacagatcgatatttgagttgctctaaagggtagattagttgaactcaattattatagggccaccaaaaaattcggccgcacagagcaaatgttagaccacaaagccgttacaaatttgtcctaacctaatcagaacagaaggcacaagcaaagccccagaggagccgtaactgatttagccacaccagaggaagcaggagtcacgggggcgagctcgccgggatccctacgaagcccgcggagcagcctctcctcctcctagaagtgtggtgatattgccaattgaggttcctgagaaattattgcttgtcaagctggctgaaattattttgaacagatataattagacagggttgtatatatgcatgcaattctaatacgaaatatcagagactattcttgaaaagaatgtgaagaaaatgaactgaattactcagattctgtggatagtttaattaaacacgcaatatctttctttcagttaattctgacttcatgcgttcttaataggaaaatcattcacactgcaagttaaactaaaggaagcaatgaattgtccgatcatgttggcagtccattatttctccgccgtgttcagcacacatcacgtgcaggaggaggagactggaccccaagccaacacagtacacgtgaaccctttgtagatcaaga

SEQ ID NO: 109572 - DNA, 557 bp, Oryza sativa
aattaaattagcattgtttagttcggcctcattctatctttaaaactagtatatgcccgtgctaacgctacgatctttaatattttttaataaatgactaaaattttgtgttagtaaaaataatcagtttaatgggagctttaattcaaattatgccatatatttaaggcaaattacaaagtaggtacttcacattgttcgtctgaaataccaccaaaatacacactatttctctccaatagcaatttactttggtaggtgttccctgcacctgtaagtcatataataacttgtcaccatgagctgaatcagaggaacgtaaaatatcccttatcctaaagttggcatcaatatagaatataatgctatacctcactttatacatggcaatgtctccaatcatggccagctgcaataaaattagatattaaaccctagccaatgcatattagccattcttcctaaaaaatatatggcaaggtgtcctaccatggcctcttcatttctctacaacagacatttttctaggtataaaataaagcaccttctaacattat

SEQ ID NO: 109573 - DNA, 687 bp, Oryza sativa
attcctgcagccctcatttttatttgagagggactaccccacatttactagtgcaagggaaagcaaagctgtcaaaccaggggaaccagtccttaggtcaactcctttcagaatattttccatagtacagatgatggcagagtgcaatttacctctgaagtgggcacctagtcgatcaaaaccaaagtcaagaatctgcaacccagacagtaataataccagatcaaagaatacttaaaaaatgtttgttacacaagcaataaaggttggagtgcaaatatcaacactctgaagtaagcaatcatgtgctgcactctaaatttgtgaaacataacaatatgtattggtatctaatgtcataaaggatatgtgaactatgaaagatattatcattaatagctatagaatagagcatactcatagaagcaagttagaatatgaatttctaacttcagataaagcttttcttaatatcagttaatatacatctcaaccacagttaagacacgtatcttattcttaaaatgtttcatatgcattattctggtgagcctaaaaattaacacacacattaagattgcattcagaatcaaagatgacagaccagactgatcagttcaagctaaacatatagcaaaccatctatagatcttgctaccaactcaaacaaaaaaaaagttaagatgg

SEQ ID NO: 109574 - DNA, 592 bp, Oryza sativa
aatgaggtttgtattattaaaattagcaattaagctctgaaaattccaataaaattctaaagagcttaattaaatatggagaatttaataaaattaaatttaacctgtcattttatttattatacttgctttacttgtaaattaattttttacacaagggagggaatataacctttctacataatgtaaatttttcttaacttttcctttattttctggtctatacacttcccgttgcaacgcacgggcacttttgccagtggaatataaaatcctggagttcctcctaggtgtagtagcaaatactccctcaattttactatacaatttattctagcatttctcatattcatattgatgctataagataagagaaatagtaagtaacaacatagccatggaaagttggacacaatactctgctctaccattagcaaacaaaatctgaaagccacgtcactgagcagggtacctatttcatcacaaacacatgcacatatatttgatcctcgtacgaaaacttacaaggaaaaaaaaaaaagagatcgtatgaatatcagcgaattttttttcgcgaacgcgaatatcagcg

SEQ ID NO: 109575 - DNA, 1738 bp, Oryza sativa
caaatacaggttggagcaaggaacgactccaaacccgtcaaacgcggtatgcacaccgtcaacgagacggaaatgctcgccgcccaattggatctccttatgaagagaatggacaacaatgagaaggacgccaagaagggtaccgttaaggccttcgacttttcaaatggcatgtgaggtctgtggcaatgacgatcactctgggacggatcgtccgaaaacctgtaaggacgtcatgctcatgaacaacaacaacggatatcgtccacaaggagaccaagtatggagcattgctccatggtctagttcaagaacggaccgaacccacaaggaggtcagagtgaaaccccgaaggacggatagtctcaacactttcatgatgaacttcctgtagcgggaagaaacgaggagccgtcaataccttaagccggcatccaagaagccaggaatataggccggtcaacctgcgttcccagttatgaagaggccgttgccgcacctaagcaaagaagtgtggcagattaaggaaaaaacacctgctcctttacctccggaattgggtgccttatcgagctaaatgcatcggaggtactgtcgtgctcgtcagacttgaaatgatgtcgcccttgccaacaggtaaattggtagttatttcatatttattttccattgcatcaaagcatgtttgaatttttcaaacgcagcaaaataaaataaaatttttggcaaaattttgcatggccaccaccacactagtcgttggaacccaatggctaaatgtggggccggttgggtccaccaggggttcggccgaacccctgcatggcactggctggctgcaaatttctttagggtagcggctagtggggcccacatgccattactagccattatccatgcactatataagcagctcggctgggagagggaagtcacaccactctaactcattctcactccctctcaaaaccttcctctcaaaattcattcaaagttttgcaagcttgcctcaaattcacacaatttgctgcatttagtttagacactttacatatacgagtttgctttagttcggtgcaatgttaatcggtgggtatttgtttaacccccgtccgagtagtcttgtattcttgctctttgttgtagctatgaagaaacgacttccgggcatattcaagagacaatcaagctcacggacaagccgacacgataagccgagtacaccttcttctgcggatgcatccatggagaaggcgtacgttccaccgaggctgtacgacaactccgatctcgaccttgtgggcgaccgggaaatgcaagcctatcatatgctgaaagaccgaacgtgtgctcagacctaagcatacaactcgacctttttgaaaggataagtatggatgctgagtttcatactgtttgacgtgctgttggatggaataaatttgcatgtgtagatgagccgggttcctgtttgcttaacatgcagtttttatgtaccttgctagaggtaggtgatggggtactttctggttattccgcaaggaatatcacctttctcggaaagaccttagcttgcatctaggctttgacaaaacatgcaaagttaatttcaggaacgcatttcttggtttttaacaagcgtatgttttggcaaagtatttcgggtctcatcctgtaaaaagcctagaactagtgacatccataatcctaccctggggctattgcataggttgcttgg

SEQ ID NO: 109576 - DNA, 532 bp, Oryza sativa
tatagggcagttatgacggttgtgagaaggggaaatgtccgaattgtcccgcaaccattattgggagagcatctggagcgtccacgccaaaccctaggatcaacggtgatcggggcggtttggccgaacctgggctgggccctcctagcctagccttcggtcggtggactccctagactctcctctgtctatttctcggagttttgggttgatttactgatgttttgatgaagttcacaacccttccttgtatggatacataattctcactttagtctagatttcctcccaacatcagggtttatcatctgcatacaaatatacaccaacacttgtggaatatgtgagattaagcacctatcactatgttggatgttttattatctaaactttatgcagatgggatttttataaattttcgcaaacaagctcttttcctcatgttgacttcctctcttgtctctcaaggatgtatattttctttttggatcctcaatcaaggcaaagtgtgccaaaatctaccctattctaa

SEQ ID NO: 109577 - DNA, 548 bp, Oryza sativa
cttatatttaacctttgagagagtatttaccaagaacccatatagcagagatataaaacagagcaactattcatcatttcaataaagagaactagcttgtcttacctagcatgactcaaacctatcctatctttttggtattttctatttttcaaatttttatgttgttttcaagttttataagatgcaattagaaagcaaatatgcaattagaaagagaaatatgcaatgtgatacaagttaccttagtagggggagcgatgtctccccccaagtttggctttcgctcagggtccttgataaggattgaatccctgaaaacggaagtatgcttgaaggtcatcgtgctgttgctgcatcatgttgttgatgttggcgaactgagcatcagcagattgttgccattcttgcgtctgagctatgtgttccgtgaggttgtactggatctcccccgtctgcatatcaagggtgtccattctcctagtgatttcacccaagtcccaacgagaggaactcgagccccattcacttggagatggaggcacacc

SEQ ID NO: 109578 - DNA, 790 bp, Oryza sativa
atagagggaggatggggtataggatagtgagacgaagaggaagaagggtcacggcaacgagaatacacataggcatgtgtgttttccatggtagtcatacgccggtccaaagaagtgacttgagaggatatcctggcaacctcagaacgaatgcccctcgcatcctcatgcattgcttcagccctcatgctcggtagttagcctttgaatgctttcacttaagctatttatagccccaagcaccgagttgaaatagtcctgaagaggcatgccaaagtatgcataaggaggagtgaagtactcattgataccttgaggaggaggaggtgctgagcttgagattgccccaaggtggaaagaaggtgcctcatcctaggagtatggggagtgccaagctgaagaccaggcttatattgcttatgcttctttagattgtttccaacactcccaagctgagcttgaatctacctcataatgtagggcgcatggtaaattcattgactaaacgtgcccttggatattgcaatctcttgcattatgaagttccccacatcaaactgacgaccctgcatgatggcatttatcacatgccaagccacccccttaatatcatcattattcccacatcgagggagaatggtggctctcacaattctgttcaccacactaagaatagtcatcaaccctgcaacttttccatgggtggtgtcgccttccatcttcatagacctgtgaaagataatcaatggagagcgggttgtgagtatgctccttatgcagatcatcacca

SEQ ID NO: 109579 - DNA, 555 bp, Oryza sativa
caatgtacatgtatatactttgcacgttaattcaaggttgataacgcaacacaccttcggttaataaaggaccgatcacctttaagccagtaatttagcaagttcatctactcttaaggtaccctgtggaacaacatctgatagaaattctcgtgcgtgatcatttctctgcattcttgatcctcccatgacaatttctttctttttgacatgatcagatactttatgttcttcaagatgcttatttatccttacattcttggctggctcagtcttctgggtaccatgggacttccttggtgtatgccggagtaccaggtatcgtggagccgtctttgtaaaagcaacagacttttgatacacataattggcatcagcaaactcattttcattcagcacgagtgccatgccactgtcaatggcttgtttgaaaaggagtaaaattccttccatgtaggaagggactatggaatcactgttaacaccatcgctgccgtttaaatgtttgcagtttctcctcatagtttccaattcatgaatctcatcactgctgcc

SEQ ID NO: 109580 - DNA, 729 bp, Oryza sativa
gaccgcacatgtcaaacctaagggaccacggcagaccgggtacacagagacggtccacgggtcgacggaagcggaccccgtgtgtcaaccgagacgggtggccgacaaacggactccactagacaccatgcgggctgcacacgtggaaaccacgcggctaccgagcgggcacacaaacacggtcaccacacgcacacacgaacgactaccgacaccggtacacgggtaccggggtagacagccgcacaacgggcacggggcgacaccgaaaggacgaggacggaagcagtgaaggagagatccttaccaccacacgacgaggcgtgggtacgacgacgaagaacgggcgcggcggagacgactcagggacgacggaggcgaacggcgagggaacgacttcggcggcgatccttggacgaaggcgagacacggccgacacaaggcttgacgacgcggagccaaggacgaagacgatgacggggctgcagcagcacactagacgaaacgcgggcgacgaacgcgatcggcttgacggagggacgaatgccacgacgatgaggacgacgaccgggaccggcgatgaggcgacgagggcagccgacagtagctgcacggagacgaagacggcgtggaacacgccgctgcgatgccgacgatggtggtgcagcggggtgatgagccggcgaagaggagcggccgaccaagggacgtcggcgacgaggaggatgg

SEQ ID NO: 109581 - DNA, 609 bp, Oryza sativa
tcggtcggttttggggttgcatcaagggtttgttgtttacccagccttagtgcttgtgctgtggttctgttttggcccttgaggaagaagaaggggaaaggaatatagaagatctgtttggattcggttgggtggaaggaaagaaaaaaaaaggaaagaacagaataggaaagaaaaagaagattagatcgggtggaaatccgtttccttttattttgtgcactgaatccaaacactagtgctggccgcaatattcagctccacctctctgtggtgccttccttcctccgagtccgactcctccctctcttctatcgatttagatccataccgtgtcttcccgcatagcttggtgaaaattttcagagtgtccgattggagatccgtttggaaaaacggaaccaatataaattcagcattccatttttgtataattttaatttttgggtttgcacttttgcatttgaatccctgtaatttgtatatttacagttgagtccttgtaatcttgcattaaggtccttgagttggtttttgctgaaaaaaattttaaaaaaaagaaaaaaaggccggaaaggtgttaaaaagaaagaaaacaaaagcggcacc

SEQ ID NO: 109582 - DNA, 740 bp, Oryza sativa
tgaacgcacccaatacactccaatatgtccagaaatcatgttttagcgctttttgaacattttcattccggtcaaaaacatcgcccctatttgggccaaaatgtgccaatattggcattaattgataaaagttcgccgtgtaaatcatgaattcagtttttgccattaacgcacccaatacactccaatatgtccaaaaatcatgttttggcgttttttgagcttttttattccggtgaaaaacatcgcacccccgtgtgccaatgttgccattaattgacaaaagttcgccgcgcgaatcacgaagtgagtttttgccacgaacgcacgcaacatactccaatatgtccaaaaatcatgttttggcattttttgaactttttgattccggtcaaaaacatcgcaccctcgtgtgccaatattcgcattaattgagaaaagttcgccgtgcgaatcatgaagtgagtttttgccacgaacgcacgcaatacactccaaaatgtccaaaaatggcgtttttgaactttttgattccggtcaaaaacatcgcaccctcgtgtgccaatgttgccattaattgacaaaagttcgccgcgcaaatcacgaagtgagtttttgccacgaacgcacgcaacacactccaatatatccaaaaatcttgttttgccgtttttttgaacattttgattctggtcaaaaacatcgcacccccgtgtgccaacattggcattaattgacaa

SEQ ID NO: 109583 - DNA, 512 bp, Oryza sativa
ctaaaaatttatatattacttgtgataatcatattctaagcaggggttaagataatccaagggtagagtgacacacaagcattactactcattctcataatatattatctgagctaagtggaaagaaaagagaaagaaaatctattcctatagttctaatatacatagtatacatacattctagttaactgatatactagctaataccctctatccgatgccctcctggtacttcgagaagccacccctgactatcgagttccttacgacagtctgtcatgaccatacaaccagagctaaataccgaggaatacccttcccaagaaattaacttacgactatataccggcgcaaaggaatacccgtactgagctgtcaccatcagcggcccacctcccatccccaatatataaccccaaataatgatatctcgtaatctagacaccacgtctaaactaccagatactactataatatcatcatcatgacatagagtaattgcataagccaac

SEQ ID NO: 109584 - DNA, 697 bp, Oryza sativa
aaaagtgtaggatttttttactagggcatatggaatcagttggatgtgtgaaagtttgttttcctttgatttttgtaattgatttaggcaaaaggattgattgtgtactgccattactatgttgtttttaggttaagaatggatcctctagagtatttacctgttagatttcactttggtggggatttcattaacaatgggagggaaaccttttatattggtggatctgaggggatgtcctacatcaaacgtgataaggtctctctgcctgagatagttggacatttgaaagatcattgtgaagtgatccctggcatgcttctgcaatggttgtttcctggcaaagaacttgcagatgggctgagggttttgattgatgatgaggtctacaattatatgtcaaactgtgttggggaaggtggtgttgctgatatttatgtggagacagtaatggcagaggggtccagtgagtctggcagcaaggaggatagtgactttgaagatgaactgcaggacatatctcctgcagatgatgaatgggatgatgaggaagatgaggatttgtttgagttgaatatagggaaggaagttcttgtcatagtgtctacaccagagaagacaaagagagatctggaacaagtgcgagcatttcgtacacctgataaagaaaaagcaatggtagtagctgaacctagtg

SEQ ID NO: 109585 - DNA, 2283 bp, Oryza sativa
gggtggggggtgctgcacgaatcttaaaatttgtgcgatgtgaagaggggaaataagcgatgtatagatagtatcataaatctaaaccagggacagttaactatttcccactgttcacttaattattacatctgcaaccatggaaccattgaaagaaatgtagccattatatatatcaaagctatatttggtagcttcttccttcgttacttttccctggatggcagaataggcaagcacacccagtgttaatacaggtcccatgcctgcgaaaaattctgtagcaatccacctcacacgtctgcggatcacacgccgtacccggagatatgaccaccgttgtgcagttctgcgcttggtccgctgccaacttgcttgccggcacttctgtggccaaaaaatgcaacaaatttatgtgaaaaagtactcttgaaggatatgcttgttcagcaaatcagtgttggagttgggtgcaaattaaagttacctgaactcatcgccaggatggcaagggccataagcatcagatgcccaatcctcatgaaactctgttggtcgcaccgttgagaatgggagatgttgcgcaaggtgacctgggtcccttggcttgtggatagttcatatatagtgaaatggcaaggctttggtttaatttgctctggaagttgatatttttttcttttcgggatcagttttggaatatatgatgatctttaatgtgcataattaatatggatatattcttgtatctagaaacaacagatacagttaataaataggtcatgggccactacaaattggagatatgcacatccagcttggcatttatagcatatattcatcagtgcagtcatggggccaggccactaattgtttgttggggcattttctacttcaaggttataatgaaacagcctcaaagatttaaggggctttttcgaccttttcattttcaaatcccaactaaaacagctttcattccccctggaagagctcgtaggaacaaattgtatccttatcacctaattgtaggaaaggttaatcatgaatgaattttaacatgtttcatcttacatatatcaattgctttgctccatatctttctctgtaaatattaacatcttgcattatatcaaaatatgaacatattgcacaattacttgaggaaaggtttgcaaacataagaacaagaagaggtagagatgaagacaaaaaggtctttattggtatatgggaattttgtgctattattgttgtttgctacacatcccttggaaaagctgaccatatttgtcaccttgtgatgacacatgaagcacttgctacgatgaaaaagctcttgcataccaaaaccaccttgcacagaaaaaaatggaatgtccaatatagaaatccttaccaacaatcgtttgaaaattggaaattgttatagggaaataacttgaatatatcttgagaaaatatatttaaagatcattgattcaatccaacaatgctaatatattaattgaaaatgttagcacacgaagacatatgtttcatgggaaccaaaagcgtaaatatgcttaagtggaatatatttttcataaatgactagtttaaaacattttgatgaccacggacccaaacatgagcaattcaacatttaaataatttttttggggggaatattagcaattccagccgggcttggtctggaggacacgacaacagtagtgatggaggcggctgtgctgcacacggagcaacgatggatgtggcggtggagggctagccctctagcttgggcttctgtggtgccgccaaccggccagacatatgccaccgtcactgtcatttgtcgctcaagcacagatatcggtgacgctagtaggcaccacacaccatcatggaggtgatatgtgaaatatcgatagtgacattcccaatgtcgtagcctgctacaaggcgtctcattagaggttccctattggtgcggcatccttatggcgatgtctgtgttggttgggtttgatggcaatggtggcatttggatgaatgactgatttatataactcaattactctccgagttatcttccgctttgaacgtcagtcacctatagttatgggaccgaaatttgatcggcaggagtcggccgctgatttctgggtttttgcttttctggttttaggaaaataaggactacatacatacatctgattaagttgtcgatagaaataatggttatgcatgaacaactatatatagaaatcttgatctctttaaggtggtaaactaagt

SEQ ID NO: 109586 - DNA, 8467 bp, Oryza sativa
gggggggtacgcacctggtgttatcccatgtactcattcctgtttgtagtgcatttgattttttgtcaaggtagagtcagtttattttcattttgacccttccaagaccacacagtatacacaaagttttaggtaaacctaaatatggtggtgaatcatctgtttattatctgattttgtctttttacactatttactctcaagtatcctttttttgtctcatcagataatgctagtcagagtgttgtgccttcaacatctacgtccactccggaaacacaggaggaaggagagccaggtgaagaagatgaagtagcgataggtgaagaagaagaagaagatgatgaagaagatgaggaagagttagatgaagaaggaatagacgatgaaggggaggagatggaagagcaggatgtcttggatgttggacaaggtgtgatggagaatgagaaagggacggagaaagatgacaaagatggtggggaggagagtgatagcgagaacgaaatggccatggaaatgttggaattcatggacagtagtatgatgcccagctgataaagactggtggtaaaccggaaataataaggaaattattttcttagttatggttagagttcataaacatttcttagaggtgtcgtggacgagtggatatgtcaccggactgtggatcacaaggttcgcggttcaagtcccactgcggcactaatgtcctttggcaagacattgatctacatttgccactctccacccaggtgttaaaatgggtacccggtaggatgcgaaagctaatgtgcttacattagcaagtgtgtgcttgtaaaaatgacgcctggctggaatgctgcccaagggatggagaatgtgcatacattttgtgtgggtaagcctgaatccaatgaccggggtaataatatgattgtagggccctcagggagaacagtatgaatactgatgaggctactcaaacaagacataatattattattattattattataatggatgaagatgatttagcgatgtgggaaggagagtaacactgagaaaaatggcagaggtgtcaaagtcgagtggtctaatcacttgactgggaatgcaaaggttgtgggttcaatgctcgtaacagcttccatttccttgagcaaggtattttatctacattgctcttctccagtgggtacccggtaggatgcaaacattaatgtggttggattagcacgtgcgcacccgttaaggaggtgactgactggtatgctcctcaaggagtggagagtgtgcagaatccatccgttgtaactggtgaaacgctttataagaaatctttgttattattaaaggccatcaaaatataagaactcatggacagcagtatgatgtacatgtagggctgataaactcttacatggtagaccaggggggtgtttttatgcctccgttacgaagtagccggaggcattatgtttttgggttgtccgtccgtccgtacgtacgtcccgttctcgtgatcgtgttatctgaagaactggttgatggattcctgccaaactttggtcatgtatgtatcttgtagagccgatgaactgattagattttggggttacgaggtcaaaggtcaaaggtcacagggctcattatgtatgcaaaacgagctcgtgatcgcgttatctgaagaactggttgatggattcctgccaaactttggtcatgtatgtatcttgtaaagccgatgaactgattagattttggggtcatgaggtcaaaggtcaaaggccacagggctcattatgtatgcaaaacgagcttgtgatcgcgttatctgaagacccgattgatggattgctgccaacttaggtcatgtatgtttcttacagagccaatgaactgagtagattcttggttcataaggtcaaaggtcatgagctcattatgtatgcaaaaatagcttgtaatcacaatattctgagaacctgttaatggattacaattgaacttgaattcgaaaaatttcttctgttttggtttgtaaaattgctctatgacggaggcatcattttcgactgcgcgcagtcgaagttccatctagtttttttttttttacttttcataaattccacatcaagaaaatgaaatctccttgataatagaaaatatgaatgatttaaatcaacattttatgccttttaaaataacttttcaaaatattttcaaagatgctcacggctttccataattgttaaatccaacttagagataagttcaacttagtatcttttttaaacacccccccccccccttcagaaataatgaggtagatgtgttttcttggagatgttcatgaacaaggttatgatggataaaggtcatataaacatgggggagtgacagaatgaaatggccatttaaatgttagaattcacgaggtggtaccatgctgagttgatcaacacattgtgtgtaattgggtttttacagacatgaatcaatcagacaagattgtttacgtccggggactgacctttaacatcaccatccgaaagaggtgactcggtttcgaaccggggtccatctgagccagtttgtaggcgaagagacagagagctgaccaagtgaatgtactgctagaccaactcacatctctctgataaacacagatagtagaccaggggtgtgtttcacatagactagtatcgattataagttggacttaaatatggtaggctattcatgccactagttgttctcaccattggtctctcaagggatgtcacaattctacagaatttaaattttttgatagttcattgttgaagaaaaaacgttacttacctttgtaaatgtgcattatatttaagactttttttcttcaacaatggtgagagcaaacagtggcataaacagcctgccattgtcaagtccaactcaaagtcgatcttagtctttgtgaaacactcccaaaaatttatgaggaagatgtttagagttcttgaacagtgaggggtggagacggatgatttagatatcagggagaggagagtgacaacgacagccatggatatatcggtattcattgacatagtgcgatgtcaatccaatagtcaagaacaagtgaagaataataaattgctcgagtgatatgagcaatttctaccatgctcagttgataaagagagatgaaagacaaggggggggggggtgtttcacaaagatcctaagtcgaacttatctctaagttggacttaacaattacggaaagccgttagcatctatgaattttttttgtaaaagttattttagaaggcataaaatgttgattcaaatcattcaatgatttctattatcaaggagattttatgttcttcatgtgaaatttataaaaagtctaaaatacttgaattttcactattgaacatattatattttaaggctactaatggctccccataatttttatgcctccgccaccgaaggtggtgccggaggcatcatgttttcgggttgtccgtccgtacgtccgtcccgtttgaccgttatcacaatatctcaagaacaatttaagatttaaacttaagactcgggaatagtatttatcaccataggaagacgatctgattagattttggagtacgtaggtcaaaggtcacaggtcacagaggtcaacttatgaaattccttgtattgagtttgttagcgcgatatctcaagaaccatttgagatttaaacttcaaacttaaggatagtatgtatcaccataggaagacgatctgattagattttggagcacgtatgtcaaaggtcaagggtcacagaggtcaacttatgaaattccatacattgagattgttatcatgatatctcaagaaccactggagatttaaacttcaaacttagtgatagtgtgtatcactataggaaaacaatctgattacattttggagcacgtaggtcaaaggtcaagggtcacagaggtcaacttatgaaattccatacataagacaatctgattagattttggagcacgtaggtcaaaggtcaagggtcacagaggtcaacttatgaaattccatacataagacaatctgattagattttggagcacgtaggtcaaaggtcaagggtcacagaggtcaacttatgaaattccatacattgagatcgttatcgcgatatctcaagaaccactggagaatgttcacttcaaacttaatgaaagtatgtatcaccatatcataatatctcaagaaccactggagatttaaacttcaaacttaatgatagtgtgtatcaccacaggaagacaatctgattagattttggagcacgtaggtcaaaggtcaagggtcacagaggtcaacttatgaaattccatacattgagattgttatcatgatatctcaagaaccactggagatttaaactccaaacttgtttaaattgctctatggcggaggcatcattttcgactgcgcgcagtcaaaattccatctagtttaagtccaacttaaagttaacttcaacttcagatctttgtgaaacacccccagaactaggagtgaggaacaggtattttcagggagatatttggatttctgggactgtgttatgatgcccaactgaagaaagatgacttttaaatgtaacttaaaggtaatgtaatttaaaggtaaccccaccccaagaaataccttaagtttttctgagagatttgttgtattcttgcccatgaatcttcaagattccccgccaaagggtatgagagaggtaaaacaagattaatgtatttttttctgcggcaaagattggggtaaggtgcttgttgagcctatgggaaagtttagcgttagggttaaatcaagacctcttttttttttaaagcccaatctgtgccgcagaaaaaaatgatgcctctcgcgcaatcaaaacccctcaaaataaggactttcgcattccgctatggggaacatggaaactaatgaatctgattgactgcagtatttaatattagtcatttcgtttttcaattagtctccattgtaagctaccaaacatgttgatgaaatatgagtcatgctaaaagggaacgaagaatgctcgtgcctcgtgtgacatggaatgatgataatgtgcagattacattagcgaggcattatggtcatcctaacaatattttaataattcccactgtagcggggcaaaacttgtatagcgccatatgtggcgttcagaaagtttgtgcaacagaaagcctagtcaaaggcatcagacttgatgtttgttaccacagaattcatgactttgctccggatgaacaaatagttggtaagctacgatacatgattcctgtagataactgatttactgtcaaatataggaatctagttgtttcagacgaatgtttatttcctgtgaattatgtgcaaatggtgagttgattttggatgattaacgcaacgttatgtacagaaggctatgtgttgctatgtgttgctaaggggctatgaaacgcattgcattagcagggttacattacaatgtgtgtgctattaagcagagggggttggaccaattagtgaacagagtgcatatgatcggacagttatggttaatgattcagtatgctacatgaagcatttatatggtttataatacatatatacattgtacgattgataagatagaatgccaagggtataatggcagtcgatatgttaattcatgtaaactaggtcggataagggaccgtgttgttgtgttgaattatccatgattcattggataaagtgcaagatgcacagtgggataatcatttagttcagtttatatttaccaattgggttacagtataagtgataacctgtgataagttttgcatgtaccagtatgggtatatagtaatggatcagtttaatttgtttactacattaatgtattgtagtgctggaaggggggcccaggccttttgtaatttaaacgttatcatttaaagagcgtttatgatgctatttgttgaaagaattcattaataagcaaccaggatgtaatagccttgatgtatgtgattcaaaatggataaggttcagtttcagaatagtaggtatacatgattcaagttatgctagtagaagaaacagaaataattactctgatataaacaggttaatgcatccatttgagtttactacagacatgctccaagcagattacaatagatgacatatattgttgttcattgctttaaacatacaattagtctttgttctaactagagcatattatttatgcaaatatttgttatcttttctcttagtgaaccgcgttacaaattctattcagataatataatgagtattaaaaagtattaaaattggagtcttggcagtgtgctaatcacaagtgtgacatgggtacgttacatgtataaacatattgcacatgataaaatggaagtccttgggtattattggtcacagtaagaatagccgataattaaagataaagaccagttatggtcatgcgattgcattaattgtcaaagaaacgttgtggaatcgatcagaaaaggatgatcatctagcatataagtagtggtgtgtactgcaaggttctggaatcatcaaaatgataagaaatgtggcccagtcttcgtaaagttacaaacactgtacacagaaagatgtatatgggacaacgcacatgtgcgtttatctctcacaaaccaatagataaactgatttaccaaatatatcaattagtaggcggttttcccggcaaaattgttatcatcatgtattagcagtggcgtaatgagcaaaaacgtttgggggggggggctgacaaaaaaaatccgcatcaccccactctaacatgcaggccccgctgaacgtttttcaaagtggggtataggggcaaagccccatcagggggtcagggggcggagcccccgaagctcaatgggtatgggcatcagtggtggatccaggagttacttacggggggggggggtggcatggggtgaaatacatgtaaaacctgatgaagcgacagagcgaggctttagcggcgagggagcggaacgaccaagcgggggtgggtctgggattagggattaggaagcatttgcaattttaaaaccacattagacgccttttcaggcacttcctggagtaatatgacacaaaattgctttttgcgcggaagctttgatacttcattaaattattagagaaagattacgatccgttgcaccgttctagactttttattcttgtttcgcccctcccgcgcgaagcgcggaagctatgacgtttcatttatttattagagaaagaagacgattcattgtaccgttctcgactcttaatccttgcctgaattcattttcgcccatcccgcgcttagcgcggaagcttttacgtttcattaaattataagagaaagaggtcgattcgttgtactgttttcgacttacaatccttgtccgaattcagtttcctccctccggcgcaaagcgcgagagctttgacgtttaattaaattattagagaatgaagacgatttgttgtactgatttctactcttaatccttgctttcacatttcattaaattatttggaaaagaagacgatgcgtttccttaaatgtttactcttaatccttgtctgaatagagttttccccctcccgcgcatagcgcggaagctttgaagtgtcattaaattattagggaaagaagacgattcgttgtactgttttcgacacttaatccttgtctgaattcagttttcgccctcccgcgccaagcgcgagagctttgacgtttaattaaattattagagaaagaagacgattcgttgtactgatttctactcgctttgtctgaattcagtttccctccctcccgcgcgatgcgcggaagctttgacgtttcattaaattatcagagaaattgtctgaattaattttttcttttctttgtccgataaaaagtcacagttcgtagggagaaaaaaaattgccggccgaccgacaatatacatctcaccgacttcaaacttttaaatgtatatagtacacgagctagatagagcaagaataccgacacagcggacccgacacagcaacataatttatctatgcgtatctttcttgctccttcgacgtggcgactccacccaacattccctttgctctcttactcccacctctcttctcttaggctctttataccaccctctctctatctctctctctcctctctttcgtttctttttcttttgttttgtttgttttcttatgtttccttttctcctttttttttctttctcctttttttttctttctccttttctttcttttctttcttttcctttctttcctctccttcctctttttttctccttctttcttttcttctctttctttacttggttatggttcaatttttttttttttggggggggggggg

SEQ ID NO: 109587 - DNA, 702 bp, Oryza sativa
ggaatggtactctgacgtcatgccacaatgaaggttattataccgatgttgttgtgggtgtaaaaaacacggacggtttgctgatgtgttgttgttgaggatctagcttttttttaaaatccactcctcgtaaaatttacacaattttctcattttatgcacgccatagacatctacattcattcaaagagacttgtggagaacctctcaaatcaattcattgctttatatgggatcaaatattccagtttagggggcaacgaggggtcttagaaaataattgaaccattggtaagtgtgctggcgagcgacaagaagtcagcggcaatgttacacaatcgtgcaaaaggtagaaatatctaatttgtggtgtaaaaaatgtgaatgaagtgaaaactatttcgtttacatgttagctgggctaaacattattctcatttctaggtttgggctgattaagtggtaatagatcttaggtgttctcataaaacaacacggcgtggttataagtcgcatcttcaggacagtgaagtcacaggacgggccaagacgaaaaaagttctcatcgactaattgtcattagtaaacgtttgaatgcgcacacacgcacacgcacacgcacacacatacacgcatactcgcacacatccactagcacaccggcgcatccgtcaacatggctgtaaatatacatgtataaat

SEQ ID NO: 109588 - DNA, 604 bp, Oryza sativa
cttcttaattgttcattcaacaaattaatacatgcttagtattcaaccaatgtcaaaatccagtggttacagttgtttttgcttagtattcaaccaatgtcaaaatccagtggttacggttgttttcaccaggtaatcaggctacatgttgaggatggattgatgttgggtacaacatttagaactagtgtggtactactactaggcttaaagtgtcactgcaataagatgctagatactgatgaatttgtgatgtacagttgaattaagtattctatcactttttgtatggaggtattgctatgcagtataataaggactaaggacaggacttttctagtgttttgttttcacctcgacccagtttaacttccttcctaaatcaggtaggttttacgctgatcgtaattataagcaggaaggcataatcatcattcaagtgtttaataaagaaatgagaatcatctacaccactcttcttaatatgaggagcttcctatagcaccatctgccgggccaccacctccgatgacatcattccatggtgcaactcaaatgggagtatatggtatcctggaattcaagtcaacggggcagcagcaag

SEQ ID NO: 109589 - DNA, 758 bp, Oryza sativa
  unsure (1)..(758): unsure at all n locations
acaatacaggtacaccacatgtaactccgcgactatgtacaaacacacgcacacacacgcgcacgcacacacaccaacgcacacgcgcgcacacatacacacacgcactcacccacgcgcacacacacacacaccaacgcacacgcgcgcacacatacacacacgcacgcacacacgcgcacacacacgtccccttcaaaacatacgggacaatagaagaatatgttgtacaaggaatcagttattttataaacctaacaaatatcgtctctgatagagaatgccgcgtcatttatacatgtatatttacagccatgttgacggatgcgccggtgtgctagtggatgtgtgcgagtatgcgtgtatgtgtgtgcgtgtgcgtgtgcgtgtgtgcgcattcaaacgtttactaatgacaattagtcgatgagaacttttttcgtcttggcccgtcctgtgacttcactgtcctgaagatgcgacnnnnnnnnnnnnnnnnnacntnnnnnnnnnnnnnnnnnntttatgagaacacctaagatctattaccacttaatcagcccaaacctagaaatgagaataatgtttagcccagctaacatgtaaacgaaatagttttcacttcattcacattttttacaccacaaattagatatttctaccttttgcacgattgtgtaacattgccgctgacttcttgtcgctcgccagcacacttaccaatggttcaattattttctaagacccctcgttgcccc

SEQ ID NO: 109590 - DNA, 1290 bp, Oryza sativa
aatcgctaaatctattctttagcccgtcgcggcagtggtccagcctgggtttagtcattaaagggggccccaatcgtgtgtatgaaatgcaagaaaacatgcaaaagaaaggtttgggagtgggagttattttcgctctctctgcctatcttttttttttggggggggggtgggggggacattggtctaactgcgtgtgtaaaatacaagagaacgtggcattagagtaaatgtggggtctgggagtggatcatatctttacaagtttcacatacttttctttaattctttctctctttttttgtgtgggtacgtgcccctacccacttgtagcttgaggtgcagcgaggtattctcatcaaatgtgaaagaacaacattttctccttttcgtattttttccctttacttggaacaattccaagaagtagagattggttcttttttttttttttaaccttggtagagagtgggcgattcatgtcgtaactataacgggggtatatagaaacatctccctactcaactatagtgaaatcttcagttttaaaggtaaaggtgagttctggtaaaaaaggagaaaataaattctcacagaatcaaacgaaacttacactgaatgtttaagattacaaataaatgtcaattgccaaacaatttttgtagaaaatgtatactggctgagtaatagcattgaaagattgggaaatcaaggttagtagccccgacaccatttgtgtagtcccatgtacatctttctgtgtacagtatttattactttaccaagactgggccaaatatattatgattttgttgactctataactttgcagtacacaccaatactaacatgctacatgatcaaaaagttccgttcctttccacaccttttcttttacaatgcaatgggggggggggggcggggggggggcttttgccattcatatatgaggcacgtgcccaatgatgtgggggggggacattggtctaagtatgtgtgtaaaatacaagagaacgtgacattacagtaaatgtggggtctgggagtggatcatatctttacaagtttcacatacttttctttaattctttctctctttttttggagggtacgtgcccctacccacttgtagcttgaggtgcagcgaggttatctcaacaaatgtgaaataacaccatttcctccttttcgtatttttctcctttacttggaacaattccaagaagtagagattggttctttgcttttttaaaccttggtagagagtgggcgattcatgtcgtaactata

SEQ ID NO: 109591 - DNA, 2178 bp, Oryza sativa
tactaaataaaatgactttaactagcaaatacaaaattacaactttcacaatgatgaattaaaaaaaagatgttaaatgaaaagaaagaaagatcaccttctcaatcacgattgatcaaaacaaaccatttaaaaaataacccctgaggcatttataatgaaaaatatgaagatatgaatgggagtgggagagatgtttcaacaaaaataaagaacgtcgaaagaaagagaaaacataaaatgaaatatttaaatatatcagacaaataagaagaaacatgaccacattatctcttattcattctacctccaattttcagactgttttcaaaacaatatcatgtgtgtcgatcatagttctatgaagcttgatgtctcatggtaatttaagcaatctaagcaacaatttctgaatttttgcgacaatcgttcgcctttgctgctctttaatactattatgacgtacagtaacaaatttaacagttgattccacttggttgattctattgttcgggttatttctcatggcttacgactttgcgttagtagttgttcatcgtctctacaatgctattttaacaatatttggtgacaaaagacggaatttccatgtagcttcaaaagccatcaaataacaaaaacatggcagataaaaagatcctcagtactgggtctaataatttaaagaacacttaatttgaacccggccatattctctctctctcactcgtttgtcattgccttcattttccctcgcttacttcattcttaccacggaatatgtaatatgtatgtgtaggcctcattatgttaattagggtcaatggtcaaattgtctcaatatatcttccatacatccataatgatcaaggctaaacagtagaaacttgacatatggatagatcataatgggagaagcattttatataacaatatgacatcgtgaaaatgcattcttcattatgtaaatcatgagcgtacgtatcacttaattcgtcaaagtgacgaattaaagtctagttataattattatcatatcattattatcatctgtattgtcagcataatctacaatggcagtagtgtagtatagtacatgtagagttaggccttatagtagaggtatcattctgatcattattattctgattatcttttgcaaaacgtctagacgataaactcatgacaattgacaattgtcatgaatcattgtctttaagtttaccattaaatgcatctggttcgagttttgctcaggtatttggtactggatgatttaaaaggtagaaattaacttgtgacctattcattctagtcttattcatttgcgttatgttttattcattcaagttctaatgtttctgactgttttcaagacatcatacggtagttctatgtagcttgatatctcacggtaattttgagagaaaagcaatgcaagcaatgatttctgaattgtagcgacaattgcgttcgcctttgctgttcttcaataatatttgacaagcagtattaattaatttttcaatgactcatgataaattcgtttaacaattgattaccctctgttgattcttttgttcggatttttttgcggggaaaatagaagtgaatgtattattattcttatttgttcatcgtctctacgatgctctttgaatcaaaaacagcttttagtgttaggcttcctgaaagaaatttcaattgttgttaagaattttttggttgcactctgtagattatgatgatgtgtttgatctttttttcaatacaagatcaaacacatgatgaaaatctactggctgcatgccaataagttcttgacaacaataacaaaacgtgagctagtgctattcggtgtgacgtacacatggcaatcacatggtagatacaattatgatcatcagtactgggtcaaataaattaaagagaactgaatttgaacccgggccataggctatcccctctcgctctctctctctctctctctctatctctgtctaccctactctcatttccccgtccataatgctttctcaattctaatgtgttctttttttcttgtatcttttccatgtcgtatacaacacggacttgtggaccgctacaggctttgcgtcgacacacccaacgtcatggttgttcctccctcggcttcagtgacaaagaaacctacaa

SEQ ID NO: 109592 - DNA, 579 bp, Oryza sativa
cacctttacctttaaaactgaagatttcactatagttgagtagggagatgtttctatatacccccgttatagttacgacatgaatcgcccactctctaccaaggttaaaaaaaaaaaaaaagaaccaatctctacttcttggaattgttccaagtaaagggaaaaaatacgaaaaggagaaaatgttgttctttcacatttgatgagaatacctcgctgcacctcaagctacaagtgggtaggggcacgtacccacacaaaaaaagagagaaagaattaaagaaaagtatgtgaaacttgtaaagatatgatccactcccagaccccacatttactctaatgccacgttctcttgtattttacacacgcagttagaccaatgtcccccccaccccccccccaaaaaaaaaagataggcagagagagcgaaaataactcccactcccaaacctttcttttgcatgttttcttgcatttcatacacacgattggtgccccctttaatgactaaacccaggctgcaccactgccgcgacggcctaaagaatagatttagcgatttattgttcactttcacct

SEQ ID NO: 109593 - DNA, 622 bp, Oryza sativa
cttgcatccttgtactttgcagtaaagtgctaatattttttttttacaattaagtatgaataaataggaagctaaaaaattttaaaatatgaattgaaagtttgaaatatctagagttagggcccctttgaaatggaggattagcaaaggaattttggaggattcattttcctaaggattttttcctatagagccctttgattcataggaagaggataggaaaactttcataggattgcattcctatgaacaatttcatagaaaaataagcaagaggttagacctcttgtgaaactttcctttgttgagtgtatcctgtggtgtaatcaaaggactcttctcttcatttcctgtgttttcaattcctgtaagattagaaaaatatacaacttcaatttctacgtttttcctattcctatgtttttcatattctgcgtttcaaaggggcccttaaaagttttggaatatgaattaaaagttttaattgagttgaaaagttttgcaatttaagttaatactgtagtttaaaatttttgggtggatttttctttaaaaaatgatttgagagttttaaagtttgagtggaaaagttttgtaattttagttgaaagttgaaatttgg

SEQ ID NO: 109594 - DNA, 2012 bp, Oryza sativa
ttggcgactgcaaggatgaaacccagacgcaggagctgctagggtttcaattttttttgggagtttttttttgccatttttctttttgcagtcagacggcttaagcgtctgcatgtggaaatacaattttcgcatgtggttgctctacccgcataaaaaatactgatttttgcagataccagatgcagatgatgggctacccacccgcctgcgagaatcaattgggactgcatggaaaaatcatttttatagtaatatactcctttcgattataaatatttaaatatttggtgtttagcacaagatatgatcactttaaaattttgatatcttttagtaattttcacgaaacgataattacagaaaataagtttatcacaaaatgtaactttatccccctatgtgtgtatgatatgcgagcctgacttacaccggcatgagtattacatgtttaagacatgtgggccagaagcttttggacaaataaagttacaaatttcttataaaatcatactctattattacaactcaatgaaatgtctagttaaatttaaagttgaagtaaactaataattttgataaaatagttacaataacctgaaatttactctaatttataattattaattttaaattattttaatattaaattgatttttagaattttatagatcttatcttaaatatcaaatatttatgattggaagagttttcttttactttattgaactgatactgatatttttctggaaaccgatacggatggactatttatttttggaaagtgataatgatggttaggtctccaattattgtaattaaggtgctaaaagcaacaaaaatcttagtacagtgttagatcaagacctgcctcagtgacaggtaataatactcttgcatctcaaaataaaaaaggtcttaatctagtctctccgacgaccagagctttgcaggcaaagtgagagcattgatgcatgcacatgtagattaattggagcatatcttgattcaataatataggcatatccacgcaaccctaatgcacattcgctaaagtgtgtctaataatttatttccatattttaactaagttttggagtaatcaatgaaagtacaatggtttgtccaaggcttaaaaaactactccatccattccaaaatataaagcacaaccacccttaaccttcaaagatcaagaaacaattattatcatgttctagtatggatcactctaataaatataatgcatgcacctaatagaattagatatcttgagggtgaaggatttaaaaataatagtttagtggagaagatatgctaattaattgcatgcatgcatagacttcttatattataaaacatcttaaaaaatagttgtgccttatattatgaaatggagggagtatgacatgatgaatctgtggcaacaaagggaaaactacattaaaaatttcacaatgtttgataaattgtgatagcaaaacaaacaacccctgttatcttttatatctctctttcttgtataagaatctggaattttcttggcggctgaaactgtcaagaatacctaattttcttgcgaagtttcttggtggttcgacaccacccaaggtaaagtgtattcttattgctctagatcaccaaggttatactttgtggcttttcgaaagtttaatattctccgtagttttttttggcgattagacagccaataaaacttttcctcacggttagcagtcaaaacaaaatctgaatttctctatcactctagacttggcagtgtccgtcaaaatatattgccttggcggttttcatactatccttgacggtttttttgccaccaagaaaattccagattcttgtacataatgatcgagtctacttcctctcgagatcttcgggcaccaaaattttctaaaatgagggtttccatggggttatgcatatatatcggggcagaggaaggagccatatcgcacatttctttttcagagaaatagagattatctcct

SEQ ID NO: 109595 - DNA, 1996 bp, Oryza sativa
actttagcctgtcatttgaagcaaatccgttgctaaagttactttagttttgttctaagttacttctataatatatgtaaattagacatatcataaaagtaatttgtgaattttcatcaaaatataatcatgtgagatcttgttgtaaatatttaattgttacgaacacaacagtgtaatcggattgtaaattgaatgagtaatttaagagaaaattttatttgaagcatagatgatgataagaatatttcccctacttgctcaatggattaatatcaaccaaaacttctaaagtaatagcacatgggtgactctggttaaaactaattggagaaccgtttgtgaaacgcctgtgcgtcacagactcacagggctgcctgcataaaaaaaaaatactgtaattaacgaacaaaaagaaaataaaaaaataagtatactgtaattaacgaacaaaacgaaaataaaaaataagtgcgagtgcgcatccggggaatcgaaccccggtcagtaccgtgggagggtactatgataccactacaccagatgcgctttaacagtgacttaactcaagacactataattatagcattttgtttctcgttgttgggacatcaatctgggcggtaacaataatcatagcttttaatctctcttagtaattttgaagcatatccaaattacagacatcgacaactcgaagatggatggagtcgtcccggcccaaatctcctgaatgcataattagcttaattggctcgtctagtcccaagtgtcgtccaatctcacttcactgacaaaatacacacactctatcgtattcgtctcctactccagccgtacaagccaagacgaatgaaactgtcatctgcctgtatgatactgtactctactacagtatctctccctggtgaattgtactactcctctcctccctccggcaaaaaaaaaaaaaaataaaccctgagttttcgtatccaacgtttaaccgtccgtcttatttaaaaaaattatgaaaaaatttaaaaagataagttacgcataaagtattaatcatattttattatctaacaacaatgaaaatactaattataaaaaaatttcatacaagacgacagtcaaacgttatacacggaaacgcagtgtttgtctttttttttttaccgagggagtactactctactagagtaagtacagcatttcacgtgttgttcgctgcagcagcaaccggtcaaaatgtgtgttccagttcttacactgatcagcaagaacacatcgtcgcagagtatacgcgtgacctttcaatgtgcgtctcgccatacctaatacatgtgacatattctattattataaatttaaacagtatatctaatatatatgtcatatgacatatgtcacatccggtagcactactcccttcgtttcatgttataatatgttttgactttgatcgtagtcaaactgttttaagttttaccaagtttataaaaaagatagtaatattttcgatccaaaataaatttattataaaaatataattaattattaatttaataaaactaatttggtaacttatcagtttgagagtcgatctttatcagtttgactttgacaaaaacaaacttaattactttgagatcttaataaattcgtttgaaactcttaattaattactttgagactctcaaaacaaacttgcatatataccgaaataaatttaataattaacttatcgactctcaaaacaaacttgcatatataccgagctttttaactctctatgtaccgtgagtccaagactaaggcgctctttgtttaggcttaggcttattggtctagacttttaagtcagcttattggcttatatgatttataagccaatggatttaatgtcctaaggttagtggttgagtcatacatctacctcacataagcccaaaaagcttctccaacctagcttttggcttaatagtgttagagtggcttgtggcttcaaaaa

SEQ ID NO: 109596 - DNA, 968 bp, Oryza sativa
ttttttttggcatcaaagtgaacaggccctaaataactattgtatgaattggctattacattggctatagatttggagctagtagtgggctatattattaaacttgctctaagcaacacccttttaacttcaatgtgatggagtattaaacaaggaaaacctacacaattaagagcaagtttaatagtatatcccactaccagctccaaatcatttatagccgatgtaatagctaattcatataatagttgcttgctatactattaatacctaatcccacctatcatacacacattgcgtcttggaatccatgttgcagctggctacagatctgtagcccgcagctcttctctttttttatttatctctttaaaatatgtttataactggcttatagcatgctattgtacctgctctaatatgtgtaatgtaaacttcaatgaaacagctactagctaaagtatatatctcatccacaagaagacgatgctgattaattaattagtgtcgtaaaagctgagaccaattaatgatggtttgattcctccgaatctccaacacaacgtacaaaaatccaggaaaaataaagtttatatatttgtctagccacataagaaacagaatacagtctgtagtgcattatctctggattgcggtttctccgtatacgagtagtatattcttatatgtcctcgctgtacctgaccttggaattttcgttcccagaagaaaagaatgagcatattagctttgtcctaatcagatcttgctggaagaactatatactgttccccagaatataagaattgtcaccatctatatgttgcttaatttatccaagatacacgagcacaaaaatatataaaatatgtaaaagcattcccctttgacagttgatctctttgatggtttctatagtctttaacctacgggaacatatccatgcatgcaagcttttggtaggtaca

SEQ ID NO: 109597 - DNA, 1407 bp, Oryza sativa
ctaatcgtgtgggtaatccatggaaattttgggaaggttggtgatatgttttgtttgtgtgggggccaggatagatccttcggttttacatggccgacagttatgtttgtcttcattgcaatggatggagagaactaagtgagagaaatttttccatatctgtaataattgaatgcatggatgctattgcagtaaataaatatattctgcacaagatcgaattcctcttaagatcatgtgtgtatgtgtgtgtgtgttttttttttgcaattatattgtccatgcagatcgactttaataattgggcgttagaaataaattttgctctcgttttacctatttttagaaggaaaggtcgcctttgttcagaggacgtccctagatgagttgcaatataatcctagcagtagctttgctgacgaacaaagtcatgctagcacatttgcattatattgattgtccacctgcttaatttattgtatcctacgtacatctataaagtttcctgctagggtcatataattgacatttttttcagtaatacatgttcaaaagtttgcattatattgattgtgttttaacttataatggtgattgtaagatatatttcttatatattattgcgcggaaaggttatatacactggtggagaaaggggctttactcccggttgggaacccccctatagtcccggttatacaaccgggactacgaatccgggactaaagatacccatctttagtcccggataaaataaccgggactaaaaatccatctttagtcccggttggtaacagatggtaggagcagtcccggttattttttttctcaaatcgatctgctccctaaatatccccgatcatattcctaaatcatccccaaatcaaagtagcatcacagatctggaaagaaatacatcacatattggaaagaaatacatcttagatcacaatacatcacatcacaaaatctcaaacaataaatacatcacaaatcctaaaagaaatacatcacaactcccagatcagatccaatatcacatacatcacagattaaatctaatgaatcaaaaattcaaaaaaaaatcagcagcggagaggagggcgccgccggcctcccggccaccgtccttgcggcctccgcgcgagctcagccggccggccgccgcactagcccgcccgagcgctgcgcccacccgcccggccggccgccgcgccagcccgcccgggcgccgcttccgcccggccgccgctcaaagaggggaaggggaggaacgggaggggaaaggggagaggaaggggatgaagggggagaggaagagatggagaaggagtaatgagaggggaggagatcaagagtccgcggataatattgagtggcgcgcggttcggggttttctttactccc

SEQ ID NO: 109598 - DNA, 520 bp, Oryza sativa
ccatatgtatcgttcacaataaaaaaaaggcaccagttcggtttattataataaaccggcacctacaacttgggggactactggtataggttttcttatgaatcaatgccaatgagtggttatatgtgtccgttcttaattttattctaataaaagatgaaaaaaataatttaggtaaatcggtatccataagattgatctctatacgatgttttgtagtttttatagtggaaacagggtttggacacactcatccgtgataggctttatccttatctttgtcgggccttaacactggacccgccacgaatgaccctcaccggtaatggggctttattgtggccagttaccgatgaccttaacgggcatcaacatgacgggccctacctagggactactggggactaagattctaccgctctcaggttatatttgatgaggctttttgcggcccaacaaagataactatctttgtgacatgccgcttgcctcaatcatggatagcccgattgggatatat

SEQ ID NO: 109599 - DNA, 895 bp, Oryza sativa
tcctgcagcccgacacgggattccccaaatgattaaccgaaaccggcaaacggaaccggcggctctgaacagctcaacacggacgaacgaacgaagcacggggaacacctcattcgaacgaacgagtgaacgactcaacaacggctgtgactaaatcggtgagctagacacgactcacgataaagccccggtatgtcaaacgataggccggtaggaatttaaggatgcacctacggctagacaacttggctaccgagcaacggctaaagcggcggctgggttaaagcggcacatagctgcgacacggcggcactagggcgacttgactcggctaggcagcggcgacttggcggagacacgcggctagggttaggattacggcacagcgacggctaggcggctagcgcagcggcgacgctagggcagcagctaagcgtggcacggcggcggctactcgacgacaaaaacgagagattaaaaactaaaccgagggaacacggatagaagtctcaccgaaccaaaatgatcggagagagagagatgacgatggctacccggcggcaacatacggagacgactactacgctagacagacagcggattaggtcagatcggattaaggccctagggaaaacctcacaggtgaacggcataggagcggcggttgccggcgaaccacggcacaataatgcaaacggagggcaccgggaggtagagaaggcgacggcgatttccggcggcaacacatgaagatgatgacgacactaaggccaaattagattagattggatcaagaccctatggataaactacaccggtgaacgacatcggagagaggaaagctcactgaggggtggcgcgacgatggaagatgacggcagacggccggcagcga

SEQ ID NO: 109600 - DNA, 1672 bp, Oryza sativa
tttgactactcgttttattcaaaaaaaatttgaaattattatttattttatttgtgacatactttattatctacagtattttaagcacaacttttcgttttatatatttgaaaaaaatttaaataagacaaatggtcaaacattgcaaataaaaactcaaaatctattatattgtgggatagagggagtattactctgcctgtctgtcatgctgtgcaagagtcacaaggtctgacgacgatctgtgcaatcttagcagccttgacagatgaccttctgcaattgtttaaacctcccaaccaaaagtttgggaaagcttaattatatattagtgacatgcttatcactactgttatctcttacacctaaatggatcttattgtctacgagtgatgcatcatatttaagcatgcacttgccctaatatatttacatatcctcacaccacaattaatacacatatatttgttctgtcatgactcatgatatgattattgctagtagctattatatgcacacatgcttataaaattaatactgatcacaatgcctcctgccttgcttaaaatcaacctagatggatgatggttccatggaccaagaaggcactaccaccaacaccaaagatcaaaatcatagcccacaggaagaagatgaaaaacaaaaggcaagaaaaagagatcaattcaaattaatcaaaccaatcctgataggttacatgctgcattattggttttttttggggttggtaagggttggtggggcctggatgccatggctgagctaagccagtagctgaggtagatagagggagagaggggagtgtggctaccacacgcctcatgcccttgtcctgctgcttttgctgaggttgatgagaggtgacctgacactgcccatatcatcacggcaagctttggggagaaaagagcaaggctacaaaacaaacggacaagttaggctgacctggagacagatttaaagatgatttggaaatgttcaaagaagagagatggagagattctagttcatattcacctttttttttttgcttgatcccttgtgtggtgatgatggctcgcatgaacattgatgcccactagctgctgtcgtctctccatgcgtttcagacaccggtgtggtatgtttgagcttggggggggggatttttgttgccgttttggctgaatttttataacgggataaattctagatataatgagaggtacaaaatacctcataagtatcggcttatagagaaaaaatggtatcaatactataggtgccagttgaaaaaccggtacccataaaaaccaccgctccgtcctcgagccgagccctctccttatccaccacaccgctctcgcatactatcttatcctctccctaccactctttctctctctctcaacgccacctctcctttcactgcctctcctcctcctccctctctgtccgccgcctctcctccttctcctttgcctcctcctcctcgccacttcctcgccgcctccaagcaccggatctggccgcctggaggttagggcccgctggatccagccttcttcaggtcggggctcgccggatccagccgcctccaacctcatcgccgtagatcaacgcctccagttccaccatgtccacatcgtcatcatctctgatgccgacaccg

SEQ ID NO: 109601 - DNA, 657 bp, Oryza sativa
ctgtacttcgtagcaaagccgctcccagtagacaaccacacgtacatggcgcacatttccgtcgggaaatcaatttaattcctaaatgtacagtacttcaactagtgaaaaaaaagggaaatgcgtaagcgactaaacatgctgctgggcctgtgaaagtcacaactcgaggcggcggcactgtggattcatttggctttttttcatttttattttcacttgtgtactgttgataggaaataagagaaagcagggatgtgtaataagtagagtcccatctcaattttgtagtactccgtagagtggagaaaggcgtgcgcttactaagctacgaatgcgagatgatgagaattttcaattgtatggggcgcttctttgtctgaaaatataagaatttagtattggttatccaccatcatgacttccacgccttcattactaaaataaataaatctaatatatcacataacatgctagtttcatttatttttggacgaagaaagctgtatacgtgagatgtgagattttcttttatgaatttagcttacatgagttttcatctaagaattttcgccgtatatttaggatacgttcggtatgcacagctgggaaccaagtaactgtccccacgggtaaaacggagtaactagtgcacaa

SEQ ID NO: 109602 - DNA, 981 bp, Oryza sativa
ttaaacaaaatatggttgtgtgcgtcctggttagcaccaaaggtaaatatactactattaaaagatagtagtggtgctggtggtgagtctgccgccaacaccatcactaacatgtgggccatgatattaggattttgggagtcatttgtagtatatagattgcaaatctttaattttctaagcatgatattttttttatgaaaggttgtgtttcaaccaattaaaaatatatatttttcaacaaggacttaattttgctattttcaatactccgttgcaacgcacgggtttttggctagttattgaaaaatgagcaaaatcatgctactgtttttatcaggactcccttttcactttttccttcttcattctagccttcataaatccagaaacgttgcgaagaacagccggctgctaagtaggagaaaagctaaagaccgatcactctttcatcgcaagttaggcagagcagcagatatgaactttaagcacatgtttgccaaaagcaagtcaaactattcacggtacggccgtatgtgccgaaatctgctttcaaagatcggaggccagtgcccttgccactcgatacctttttcattttctttcaataatcatcttatggtgcgctaatcatataggcagccgtaaatcaacagcgtcgtatatttaaatatacaacatcatatggaagaagtaacaaaaattctcaagactaatgtatatatatataccaatcatacaacctatatatataccacactcaattcacacgtcagatataaaaaaataaattcagcgtatgaatagtaacatattgttcatgtccgaatttatctttttatttctcactgtgtaggttgaatttaaactttatttttgtgaactgatagatatataccattatactctatattttagatttttttaagttttttttcataactgtttgcattaaatttgaaagaaaaaggtatacgaggg

SEQ ID NO: 109603 - DNA, 4322 bp, Oryza sativa
atgcattaaatttatccttatatgcacaccttgaggggaagtttattctataccttggaagactaatggtttaaattgagtttattctttggtctcatgttggaagtggatgactcccaaggtagacttcattattgcttctatggattttctttgcaaccttgatttcataatataggatggattcttttgttccttcatttcttttgtgaaagtgcataaagatttcttttcactctttgctatgcacgtatttagaaggagttcatcctatgttgtgatgtttcataagtcttgatatgtctcttcatcatcactacttattgggttttggcttatgagacatttcattcgggcatacatgacttgtctatagcattatatgcccgacatactttttgccctcctttaagtgagttttgggagatgcattaaagagaaaatattttttttggaattatgcttttgtgcctttctccaaattaagcgagtttaactaatcaatgtatttgctatatgtgcatatgggttcttaccaattgtgactataatcaaggcctatctcttttgattggtattcttctattaattggtgtggttcataagcacaaaacaaaaaagtgcttgctttggattggtgtttctttggactccaactctttctattggaatttcgatgagttcaattgctttattcggtgttggtgcacatgtttttcttgtatacgtgtgtacctcgaggctatttgtactttgctatattgaaactaacgcttttgatagagtttcatcttgttgtagcctctttggaaaaccaaaggtatgttaaaccatttttccttcaagtgtataggacttgtgtagttcttatatacttgatgatttctttttctttatgctcccacccaaacattcaatcttttggtgtttgatgccaaagggggagaagtataaagagagagatataaaggggaaagtgtatactcgtttcatatgttgatgaaaccaaccctctagtatatgtttcatgctaatggtaacatatactagagtattctctttaaattcctattttgtgatagtgttgtcatcaatcaccgaaaagggggagattaaaagatctatgtactagaattgccttgtaaggggagattggaatatctatgatcctaagagtgcggtgattgttttggtgattaatgacaacccattgttggaactaactatttccatgagttggtgagattaggttaagttccgccatcaagttaaaagattgaagttagaagatggacattataccttgatgaggagcaagtgaagacattgatgatgcggggtatgaaatggctatctatggcaaaccggtgaagaaaaagaaaggctcggctagaagatggacattataccttaatgaggaataagtgaagacattgatgatgcggagtatgaagtggctatttatggcaaaacggtgaagggcaagcaaggctcggctacaatggaccatgcgtggggtgaagggcaagcaagaggcttggcaccgattcaccgaatccggtggtgaaggacgagtgaaggctttgtcatgatggtcatgatggactgtgcgaggccatttgaagctatgagtaatccgtatcaattataagccgcaagatggaatgccgaggatcaagaggatgtggttcttcgatgaacatcaagtcaaaatccaaagtgggcattgatcaaagcaaaggtataatttatttgggactaatatgcttaagtgtaggtgagaatagtcccaatagcgaaatggcgttgacgttgacaaccctcaaggtgaagcaagaagatgacattcttagtggtgtattagtcccaggttgcttaggagtgggctaggatgcttggagaccccccaaaacaaagcggcaagaagacttggagccgagttagactagtttactttttcgctttgagtttaggaaaaaccgtactattaagaggggttccaagtgtggttctgagataacacaagtgctcttagtggtgtccaagtgttgaaatatttttaggagctgtttttgaaaatggctctactcgggacagagagtcccacctggaggttctgtccggaacttcctggcaccgaggtgaggttgaaaaatttcataagtgctgcccagatgttcctggcacttttacccggaagctcctggcaggtttccagttcaaacttgtgagtaacggctagatgacgtcacctagccgttatatatatggatctcgtccccaggtcaccctttggccattccactttagttcttgtgttccctaacttgttctagcatctcccaatgtgattttgcttcctccacccaaatcttgtgtacttcttgagtgagagagtgattttgagggtggtggtgaggattggagaaggttttgaaggctaggatgacttgagcacttggggtatctcgttgggctatcatttgaagcttgttactcttggagggtgacctcctagatggttaggtgtcgcccgcgagtttctaacaaggttgtggattgacccgggcaagtttgtgagggtgctattccacctccgaaaggaaacgaaatactcggtgagtggaatccgaggtgaggtttaggatgtcatcttggtagagcaagcctcacttgtggtgttcttttggtgttcaagttggggatcttagtggtcacttgaaaccaaagagaagtacctaggggtgttggcttgaagaccggagacctcttcctaggccttttcttggtgaggcaaggggttaatcaagacccggctctttggagctcctcaacggagacgtaggattctcggtggagaatccgaacttcggaaaacaaatcatttgtctcctctcactctctttatctttgtgattgtgatgcttatctccttatttgcctagttgtgctatcatgtctcccattgtatgatcacttgtgctatcttgtgtattttcatgtgtattactcttgtttgagacatgttgtacctctctatggtttaggcttccttgtgataagtacgataagtccaaccattgcccatgctggcttgtggtaagtacgataagttcttctagggcataccgcgaaccggtccttaattgccatgggtgcgactagcaaaaccatgcacccacagcccaccattcagtcgcattttagttggataattacgaccatgaagcatggctagatgtctcgagcacgcagctcattctgatactaaaaaggtctaatactgtaattatcccatcaactgagctagtggtaattaagcatggctaagcatataattctagctaggtcacataagtaacatgagctagtcgatttattacccagggttgacaaaggacagatatcaagtaaacatggcacaagcaagcagataggtaatacccggatcccatgtaattagcaagacatgtatgtttatttgcaaatggtcaaacatttataaattgggatcaacatgctcaaggggaatgtgtgacttgccttgcttcttcaaaacaatcttccgaactcttttcctcgcgaccgtggacttccgaaacgacggattctacacgctagcacgcaaaacgaggaaaaactctaataaaaaccaaggaaacagtacataaaaagtaaacaaacatgtagatctcaattttagatgaattttgcaagttgaatggcccaattcggagttcgaatgaattagatatgaattttagaagttttgagccatttaaatgaatttctagaactaaatacaatttattgtgcaattattatttatttttacaaaggaaaaggggactgctgtcgtcagcaaggggtgaggcgcggaccgcgtccacgaaggggcgggccccatacgtcagcgacacaaggggtaccggcccaccgtggaccgagtccacggtggcgaccggccactcggccgcgcacccaatggcccggatcggccgagaccgctcggacggccgagtggcacggccaggcaggaatgcacacaggcggcagcgaccgccaagcccagaccaccggcgacgacgccagcgacgagcggcgacggcatgagaggcggcgaaagagaggatggggaggggatgctcaccaagcggcacggcaccggagagaggcgagatggtgacggcgctcctcgggcttgcggtggaggggttaactggcgccgattttcatggggagagtgggggaaatgggtgcggggtggatgtggtctttcggtagtggattggggaagatgagcgatggacggggtgtgacaa

SEQ ID NO: 109604 - DNA, 757 bp, Oryza sativa
cccatgagcgaatcacacggatttgagggaggaagggagtagggtttcacgggaagagagagagaggtggccgggcggaggaagaagacgacggcggcctggcgcgtgggccccgcgcggccaggcgcgctctcagcgcacgcgcggcgcacgtgcgcgggggggggaggggcggctcgggcaggagaggcccggctgggccgggacacggcccaggaggggaggagggggaggcggcctgggccggacaggccgggaggggagggggggggaaaagaggcagcccgggagagagagggaggaggagggagtgggccgggaggggaagggggcccaagaggagggagagaaggagagggagagaaagagagggaggagagaaggacttcgggctgggcttggcccaaaggaggaagaggaggattatttttagattttctttttattgaactttgataattgttgttgttgtttaataaatatttccggtgctctgaaaattcaagtaaaatttgagggctcattttagaccaaggagaatttaacaaaaattctccgggccacatttgaatttttcttgcacgtattttagtgtttgccaatttcttttcgaattttaattaattctattattccttttaggattcttttggaagatgcggatatgtgatcatgtgtataattgtttactgacaaaggagacctagggtctcgtgtcagaggaactatattctaacctcgagctaataaccaacct

SEQ ID NO: 109605 - DNA, 5360 bp, Oryza sativa
gtctgcagcttaccttttcttttaccaatgacatggttcaagatgttgacaatgcgaaggaagcgtccaaagtcaaggtcaggataatcagactttgggatggcataaatcccaacagacgtgatacttattaataaaaggtcggtataaatattccccttgcaaataatgttggtatttatgggtatccccagagagcgctcacatttactataaacgttaactaaaagatctgtagtttattaggtcaatcgtattaccatgaccattgatcaatcaaagaatttgtattaaaaccaagattaattgtgcaacttctgggatgctcgctcattaggcagaaagatcttaccacagttgattaggtggttcgcattcctatgatattcgatatatatacatatgaattcgtgtaaattaaaatatgccacaaaaagtaacatgggcgctttagttttatttttacaaaattaataattctgaaatcagacatcatagtgatcacagagtttttcctttcttgattcccaatttagaaatttgttaatttaatttcattttttaaattcataattagtaagttgaacttatgtgaactccaaaccatacaactaaaatgtattatttactattttcataattattaaatcataaaagttacaattgggacttcaatcatgaacaatcgataaccgtggctctagaccgagtacaatttcatattttatttacaaattttgaaattattaaatcataagattctttacaattgaaagtataaagcatgtataattatgtacttttaaagattccaacttgaaaatgtataactttcaagaaaatttgatgaccaacatattcatcacaggattacatttttaatatttatgttgttaataactatagcccatgcaacacatgggttagcgaccagtattattaagaatgtgactaggtagtgcacggtagtgctttgtagtataaaggtacacgtgtccagattcataatcaggaattcattcattcggagataaagagagttagactgtattagacgatgttgttgaagttgtcaataaaacaaactcgaccaagacaggttgtacacctaaggttaactttgagcttacaactatatatgctcaacctttgagcttgcaggttaacctcaagttgactactccacaccattatcattgaaaaaccctttaatattatgattaaacactatcaaaattttcagtaagagaaaaacactgccaaaatgtggctaaataaaatatttcagtaaagagagaaaaacattgtcaaaggtgtgtaaataagagttcgtacaacagagacatgatagagacactattgccggattctctgatttggtgagtgatttaaatgctgaaatcatacaaattgaaggttggtgaattatttaagagcaataagctagttggctggatttttaaatataaccaaaagggatgtattccctgctgggaatgaatcgatcattttatataggcacactttagggtccatgcaaatcccaaaagtaagaaaatgataagtaaaacagtgcaaattgcagggataggatttttcagtacacacaattgcagcacgcatgcttatgattcttgtacgaaatggtgtcctttatatgctatttactcgttattttttagctgagctggccatagccaaattccattcatattgaaggagaagtggggttcaaaaatccaagttgtggactcatacagaattgtgtaattagtgccattaattctggaacaattatatatatgcatctgtttttctagccgtgcaaaattattttttaggccgggttaatttctcttcagctgcaattcaccttgattaggagcaaaagtacagtgaagattgcttgagttggggactgtcggcttgagcctgccaagaggtagctaggtaatcgtttgttaggtgctctatcaaaatcatgatatgcaattacctctccacaaagcaacttactagtagcatacataggcttctcaagtgacatgcatattgctagataggtggattagggcatgtacaactttcattagtaagggttcttaacctttccaagtagacaaattcgctgacatggaagagatgagagtataaagtgaaatatcgatgttaagcttaacattggtttagcatcaactgtttttaaaagagaaaatatcgactcttaacctatgtaaaaagaaatttggctacataaggatggggaaaggggaaaaaagagattttttttctgatggacgaatagtggatagtctttattgtcttaacttttgtaagggaaacaaccttcaaaaaatttgtattgcctaaaagttcatgctaagctagctacctttgaacttgtacttatgactcaagatccaaaaaaacaatacttagtttcttaacagtgtagttaatgtttgttttgatttctttaggactaacaaaattaaaaaaaatgaaccagctggcttagtttcttgacagtgcagtattctgaatgtgacataacataactaagagtctattttctttcccccttcaaaaatgggcccatatgaaatccgattaggacttaattctccaaattaagtgtaagccagcataactgaattactgattaatcagtcacaattttcgctgtcagctatatatagttgcaggctgtgcaacaaagtacaagaggggtcaagatgagtcagacattgcctctagtcccccacactgatgttgatacactcaaaagtccatctcttgcatcgcatgcatgcatgatcattgatgcatagctgtggctgtccactggttgcagacgatctctatttgatctctcctaagcttaattaattgagcagctaacttttgcagcttctaaacctttatgtgtgttccaacaccaaatgatgcatattcatggtcatgcactaattaacctcagaattgaaggaccgcctatttgtaacttttaagggctataatgctcaaagatggctctgtattactgtatatatgcctccttccacagaagagtgatgtaatttctgtcgcaatattattaataaaattcaataataaaattatagtttgtaaaagaaatttttgaaggaaataataacttatctatatataaaaaatcaccattccaggtgtcaatcaaaatatctacaaagatagttataccaaaagcatattaaactataggtatatcaatttttctgtgaaaaaaaacaaatgcatataaatcacttttcagatgccaatattaatatttacaaagatagttatatccaatgtttacagtttcttttactatagttatctcaatacgtcattgctttctgtgggtgaggtcatatctatcgactttatcagaaggtgaagtatacattaatatatgtgtaatatctccattgatctagtagtacgcatatatatgcatgaaagttaaccaaatctaaaatgtagctagacattaaccttttgggtgatttggatcaattcaagcatgtgtggttaggtgaaactacctagctttgggccttttgcacatttgatatatactccctccatttcaaaatgtttgacaccgttgacttgttagtacgtgtttgaccattcgtcttattcaaaaaatttaagtaattatttattcttttcatatcatttgattcattgttaaatatactttcatgtacacatatagttttacatatttcacaaattattttgaataagacgaacggtcaaacatgtgctaaaaagtcaacggtgtcaaacattttgaaacggagggagtatgtaccctcttgggatctagcagtgcaacgttttgtgagcaaagttaggtttcagctacctagcttattagatgattggcaatggatatggagggagatctcgtcgactaattattgtatggatgatattttggctaacattttcctcgaacttaattactagctcggcctaaaatgtcatggcatgcatgtttgctagcgaattctagagaggaaacaagtcaacaacgttttgcataaggtctactgaattaagataattaagataattaaagacaaacctctactgaatttaggattaattaagaggtactaattcctaagcatgtctgacaaagcaacaaaattcagttaggtactataaattaaaataatcaaatagctagagatgaatatacacttttttttttgcaatggtggtggcaagcatgcatgcttgcttagctatcttaattattagtgccctccaaaagggataaacatgtgtggataattgggcttatggatcttcctttccaacccggctactactgatctcgaccgacctacatgtgtacatatcttgcttaatcaatggagcttttttagcctttagcaactgttgcattatgcatgcttgtgatctccttgattatcttgctgccatccatccatccatccatggccttttgggatatgatgtgcacatgaaaagtttttttgcatcactggctgcatgttcactgttcacatgtgtacacgtacacgcgtgtgtacaaactatatgcgaattgtcaatttgctccttctttattcgtggatccttccatcccattccttcaagagccagtcgctaacgattagcctcatttagagcatgaaattttatcttttattattatagagcaagaatttagtttttttttgtaaaattactgtgaggttctatgttattgtggggtttatgtgaatgagttaagcatttaaaattttttaataataaaaatggttttacatctcctatctctaccaacatgcacaagaaaaaaataaataaaatggttcaaggttatgggatgaattcttatctcccccgataatatccaactgagatatactcgatagaaaacacatttaagcattacattagttataatttatgttagttggtcaatatttatcttcctttttctctacaaataaatttgtagtactgaactcttgatagttgagatatgttgccaagaaagaagaaatggagggagttggaaaagtgaagaaggggagcaagccgccatgatgggggcaagtgtggcgcacaagccggccagaaacaccaacaccacttcagttctcttccctgctttccatgcatggccttgtggcccactcactgacaatgagctcactgcagctagtgacagtccagttgtaacattccggcttagggcttaatagaattaatagaatactcatatcaacaagttacaacttcttttccggaagtcaatcttaaagaactccagggttaagcgtgtttgg

SEQ ID NO: 109606 - DNA, 568 bp, Oryza sativa
ctccctctccccctctacctactcctctcatcgcatcattaaagaatcatcttagcaaaattccacagaggagaagcaatcaagattcagatatcatcacttctttcttgcttgcttgtacgtggtagctaggagcgtgggagattagtgaccatgcatgtctttgtataaatataatactccacttttgattaatgattggccgggtgactcagcttaattatatctacattaatttaatcctcctagttgactgcactagctaggaaacttcattatatcttataataggatcataatcctaattatatatacagcacgtgcgttccaatctatctatctatctattatctatctattattattatatactaaaaatccattaaactttctacaaaagctcctaagccgagcgctatgtctgggtgtgtgtgagtgtgatgcattggagacaatacagggttatttaactctcctttgtcctttccaccgtgcgttgccagaaactgggtcattcaacgtccaagtccaagacattgactattggtcaacattggtgactccgtga

SEQ ID NO: 109607 - DNA, 737 bp, Oryza sativa
ctgcagccctgtaattagacttagtatgtaattattgactacggaagttgtgcgacaagtagcaattgactattgtagtcttaattagacttagcatatacgcacgaaacacttagcatacatgactcttttagtcttagcatgtaatattatttgaatatatatataagattactttatttgtaatagacttagtatataattattgactacggaagtggtgcgacaagtagcaattgactattgtagtcttaattacacttagcatatacgcacgaaacacttagcagacatgactattttagtcttagcatgtaattttatttgagttttaatataagattactttatttgagattagacttagtatataattatttactacggaaatggtgcgacaagtagcaattgactattgtagtcttaattagacttagcatatacgcacgaaacacttagcatacatgactcttttagtcttagcatgtaatattatttgaatatatatataagattactttatttgtaattagacttagtatataattatttactagctagggttgtataatatacgtcacctagacttagcttatatcacgatttgtaattagacttagcacgtaagtttgtgtagggttctaatgtacgacatttacacttagcatacatgacttagattgtaaaacataaatgtctcgtgacttagcagatgtttcttgtatcaacagatggct

SEQ ID NO: 109608 - DNA, 1601 bp, Oryza sativa
cagaggctagcaaatgattccaaaaatctgataggtaatgctgaaagcttagaacatccagaaagattcaagaaacggagtttggtcagattttcaagagattcaggaaaactagtaacttcagggcagcatgacaagtttaggtaatgtagatcatgcaacaaatgaaggctattcaatcgttgaagtttctggcaaccttggagattcaaataattcagcccttttaagttgcttataaagggtggcaactctgtaagttcagtttctgaaagatccaacatttgtaacttatgaaagctactaatttgcagagggagtgctgtaatagataaagatgaaacgtcgaggtatctcagttgtttcagctgaaagataggagatggaatatcttgaacacagcatccactgagatccaaaacacgcaagtatttgttcactgaaagaacttcactgacatgctcaaagtctgcaccactattcttgaaaattagtgaccttgccttggaaggccatgccttgcgatcgattgactctaaactagaagcagacacctgtgcataacggtaatcacaatatctggcattgcgctcattctcagcatctaaaataacaaggatatcttcaccagcaactgatctagcaagatcatgcgccaagttatgcatgtgaagcatttcctcagaagcaccagatctttctgcatcattctgcggaggaaaacagtgttacttgtttgttgagatatccctatatggccattctatcatggtcaatcttcttacggaaacttgttgagaattcagaaataaaacaatggtataagctactatgcttaatggagatatttaaccacattctagttacataggatatgtacaggagaaggtaaaaaagaacccatgaacttacctgagacctctctaaaacttgaaggaaatagattgctttaagttcatcaatatatttctccgcagttacatcaagtggcaaggttccatgtttggactcaatgaaagaccaagaacagctatagaggggggggggggggtgaatatagcaattcaaatcttacccccgaaaatactcatcaagccggatttctcaaaatccttactagaaccgcagctattagagaagccggatctagaaaagaagagagaaaaagaagagagaaggaattcccgaaactagaggaggaagagaaaatgaattcccgaaactagaagagaggtgaggaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactcaaactaatcctaatacaaaagcctctcgggcaaacacactccaaactcaaactgaaactctctcaccgagcatctcaaaaggattgccaaagaagcaacctccacccttgcatccatctctctatttataggctaagacccataagacattgtctcaaata

SEQ ID NO: 109609 - DNA, 616 bp, Oryza sativa
gcggcgtgcaggcgcaccgccggtggcgtgtggtgcggcggcggcgtggcggcgcggcgccggtgccgtgccacggtggcgtcgtggcgtctcgtggcgcggcgtcgtcgtggcgcggcgtcgtgtcctgatgaggtcggcgtcggcgtctgaaactcggcgtccggcggcaaccgagggggagagagagatatcgagatcgaagagagagatcgagggaggcggcggcggctctcaccccagagatgcggcggcggcggaggagatggaggcggcggtgacgacgacgagcgcgagacgacggcaagatacggcggcggcggcggcgcggggatgccctaggcagtggcggcgaaggagaagccgagagagatcgatcgggcaaaaacttctaagtgttggtggagaagacgagggcgcgcatcgggaatatatatacccctagatctttactcccggttgtggactaaagatcttttcctgctatttctaaattgtttttaaacccggttagggttaagaaccgggactactgataagcgcactgaatattattttccattacatatgtgtttctacaatagaagataatgcattacaattatttaaagtacaa

SEQ ID NO: 109610 - DNA, 3128 bp, Oryza sativa
tggaggggaaggggaggatgggcaggagagaggaggaggtggaggagaggggacgaggaaggggggaggtggacgggatggatcgggatgaggaaggatcgatctgatttaaactgtaggaaggggaggaagttcgacctgtggaggagaggataagggatagggattatatactacgcttgaattttagttccggttggtgtttccaaccaggactaaagatcatttaatttttagtcccggttgagaacaaccaaccggaactaaagtggtgacaccaaccgagagtaaatatcctcggccccctgacatcaatctgacaggggatgaaccgagattaaagatgatttttagtcccggttgataacaccaaccgggactaaagatcatagatggctctggggttttcaactgggactaaagatcatttttacttccggtttttttagaaccgggattattgtggttttgggtcgacccagcagagatcatttctccactagtgtatgttagttagactatgaacgaaagctgcagtttagtggtattaatcggtactacaccatgtcaggtgctatcgggctgcaccttgggagttgggatgtgtcaccagggcaagcccatgaagaggggacagatagaaaaggcagtatataaacaacacttagctcggttcccaaaaatacgtaatacgcacgaaaaacggagcggtctatttgcacgtgattaattaagtatttgctaatttttttaaaaaaaatagatcaatatgattttttaaacaactttcgtatagaaactttttaaaaaaacacaccgtttagcagtttgaaaaacgtgcaagtagataacgagagcagagtttgaaaccggctgttaccaatatagccttaggccgagtttagttccaaactttttcttcaaactttcaactttttcatcacatcaaaactttcctacacacacaaactttcaacttttctgtcacatcgttctaatttcaaccaaacttccaattttagcgtgaactaaacacacccttaaaggaaggatgaaagagaaagagcaatgctctggtgctatcagcatctgctgatagtattataaccattaaaaataatccgaattctttgttaataagggtaaattagtaatttactaatacattaatttggggtatgtcatttttatttttgttcccatctcatagttcgttgcatcgctgatatcccataaaaaaaagagagaaagcaaaacgaagcttctgcatgtggatagctagtcctcctgtcgacggtgcttgtggatcgcaattcgcaagtctctcccgccggcggcgtatacactccggcacccctgtcagatgacaagtcccttttagaaaaaaaggattgatagataatactcctttcttattttaatatatgatgtcgttgacttttttactaacgtttgatcattcgtcttatttaattttttttacaaatataaaaatattatgtcatgcttgaagacatttgatgataaatgaagtcaatgtaaaataaatgataagtacataatttttttataagatgaatataaaataaatgataagtacataatttttttataagatgaatagttaaacattgttaaaaattcaacgatgttatacattaaaacacggagggagtaaaaattcaacgatgttatacattaaaacacggagggagtatgagtttgagagctgctttcatttcactgaaccgtcaaatagactgcaagctatttcaatgctgaacaaatccagcatataattaatccagtgtaggggttgggtgtgaaacgtaatccagttccctttcttcattgcaggaggtttacctggtgactccagaagaaaaacggaaatggtaaacccttgccaagtctcccaaattaagcccctgatcttacgtaatggctgtcgctggagctcgtcgacgatagcgtttttgcacattaactaaacatctcagcgatagagtttttgcccctgatcttctatgtatctcagtcgagttggcgagcggcgctttcatgtttgagctgcgagatgagaacccttccgcacctgctagtttagtcactgcaaaataacaattatacccctcctcatatatttttaagaaaatcccctatgtacaattgataattcgtccaatcatttatgtatccctgaattttgcctcatcccttatatacacctgagttttcatttagatctcctctatacccattacgttagttgaccatgagttgaccgttaaatgtttttaagattgactatattacccctctcttatccttatgtgctagtttaatgataaaaacacaattattatatgacaaaaatatctatttgtaaataaacaaagggaatataattatttgacaacaaattttaaaaataaattaaaaaaatttaaattaacttttatggtatacgtatattgttttcatcaaaatttgaacccaacaaataaataattttggttcacaatttatagctaaaactcttatatggattttgtaaaaaaaataaatttgttcaacagtttaagttttcttttcaataaataattatgtcacatttgattttattatgagttacaatttttcacattgtgaattatgaaaaatgggcgatatggtcattttagaaaaatttaacagtcaactcacggtcaactaacagaatagggatagaggagatcaaaatgaaaactcaagaacatgtaggggatgaggcaaattcaggggtatagaagagattgcgaaactttttagggttatgtaggaaattttctctatattttttgaagaaccacaatgccttatcacgtttctactactactaactaaggtggtaatagaaatatatttgaaccatttgatcaaatgagatcaatggttcagatttctttctactattagtagagagcgcaccatactggggccctaacagaaaacaacgacttgccatggtggctcggcgcggcgcggcgcggtgacagcatcctatttcctggcttggaacctgggcgatttcctttcctactctcatggatctttcttccggccccctaccttagcttttagaacct

SEQ ID NO: 109611 - DNA, 593 bp, Oryza sativa
agaaaaattccaggaggaaaaagttgcaagtgaaaacaaaactctcgagagaacatccaaaaaattcaatgaggaaagaaaggcaaaaaagaaataaagagttgaaacccaggaaatttgaggaaagaaggaaagttaagaaaaatgaagaaaattatattgagtgaaagtcattcacaatgaacgaaacaaggaggaaattttattggagttgcagctttttcaaaaaaaatatataacatattttttgtagcatgattgggaatttctaaatacttaaaagatagtgtaaatttcacaaaactacatgtattttcactaaactataacaaaactataaatttaaaatgtcgtatcataaaactgtatatttaacattaaatttatcacaaactacagatctataatcaattatcacaaaactatatatttaatattgaagttatcacaaagttacagatttttagagtttaaatcctaacactattgttatgttatgttagagctataaacatagtttaatgattgaatcggttctaaacctatagttttataataatgttctaactaaatgggtagtgatgcacacatca

SEQ ID NO: 109612 - DNA, 1730 bp, Oryza sativa
atatatagagtttagggtcgtgcaaccaacccttgacgcaatcctaataggtttcaacacgatacatggcccaagggcccaaatacggtgacgtaacaccgggacagattctgaacgtcaaattgtttagtccattcttgttgacttggaaagaatttggatatgggaccagaaccattggaaatgttatcttcttagcttttcatccatataaagaacgccccaatccgagcacgtatgcgacctgcgcgcccattttagtatagactggtcctggactccgaagtgcactcgaaattggcttagtttgggcctccaccttgacttggacgtccttgatgatcctcaactctaagtccttctccaagtgtctccttgttctctctattgttcctaatcacaatataatcattaggtagcaatctattcttaaattcatataaagaagaacataaaaacgagctcacctctaaattcaattgccgcgcgcaagctcttgttatcggtcctcaaatgaccgatggaagattgttgtgtgtatccgaaagagtgatgtccgcatcaggtagttttgttacattccatcttaaatgtgtagttttgtgataaatttaattttaaatctatagttttgtgatagattaagttaaatctatattttttagatagtttggtcatagtataggtagttttgttaaatttactctaattatactactcgtacatgctaaataaaatataaaatagtaccctttaaatatcatataatatttttttatagaaaactttataaaatctataggcgcgccaaccgtgcgtgccgattttctagtccatactagtcgagacgtgttacacgccacttggctgggtcctgctaatgcgcacccgcactcccctccccctacgccgattcctccctcttccccctttctcctccccatcctctcttcctactacagtacaccacaaaaattttttaaaaaaacaaaagttagaaaaaattacggatagaaatactatatataaaaaatttgaatttaaattcaaatttgaattaaattttaattcaaattcaaattcgaattcaaattcaaatttgaatcgggtatgtaaaacttttaacttataaactttgaatctataaactttagatgtataaactttagatgtatagaaatacttgatatagaaaatatttgaattcaaattcaatttgaatcagatataattcaaattcaaatttgaaacgggtatataaactttaggtctataaacttttaggtctataaactttagttgtataaactttagatgtatagaaatactatatatataaaaaatatttgaattcaaattcaaatttgaatcggatatataaacttttggtctctaaactttagatatgtaaacttgaggtgtataaattttaggtgcataaatttactaaaaataggaaagtaatacggtgaaaaaaaaaacaggtagagggagggaggggggaatggggtgatcgctagccaatagccagggtgattgttcgcccattagagtttccgcgcttgactggaccatgtggcgtacgtgatgtcactgataaatccgaaccgacgcgagataaaaaaaaactgaaaaggaaaatctcgaaacgtcgatccaggattgaaagcagatggatcagaggcgacctgaccgttgctagcgacttcaccaaccaccagtccattctc

SEQ ID NO: 109613 - DNA, 530 bp, Oryza sativa
caatacgaactcgcatgtacagctagctatttgagatcaaactgaagaagaaaagaggtagagggtacaagcactagaaggttctagaagctaatgtagggggttagaggtagggaaggaaaacgccaaggctccaagccaggaactaggatgccaccgcctccaacccgtcgttgccaaggctctgttttctattttgtttgatcaatgatcctgtagttggctgaaaccaagagcatgtcaatgttatatcatacaatactataatgtaataggaaattctaatgaataaatcaattcattcattttttccaagtttcattgttttagtctgtttcccaggaaaattagaaaaattcacaataactgccttttgtttgagtctattgtttgagtaagcaataagaattggagccaataaattcccaatgggaaaattcactttttcttgttaaggaaaaaaggcaaataatttctcaaataataaccgttgaaacccgtaactgcctttgttcaatgggaagaagaag

SEQ ID NO: 109614 - DNA, 684 bp, Oryza sativa
ttgacacaacagaatagagagaattgctatttttcattaatctaacaaaaaaaattaaaacatagggtcctcaatgccaacactacaaaagaagattcatcattccagcaaccaggatcagacaaacatactgaacttctcatcaaagaaaaattgaattaaagaatctggttttgtaaggaaaatactttggaagaatgagttcaaatgaaataaaaaataacaaagatcccatgcagtatttatgaagcatgaaggtagtattctacttgagttgtaacagtgaaaagtgccagcactgatagatttacgcttccctctctagtacttatctaaagtcatacaatattattgctagtcctagtatctatgtacaaagatccaatcattttagaggccatgttaaaatggaacactagtcactttttgtcagcagagagaacattatcatcttcaatccaacacatgtaaatttgcacatacaagacttgattgaataaagaatgttcgcattctatatttaacttttattttttatgtatttcagcaaccatttcatggttctaaaactaaaatagctatgaaatcagacttactgtagtcttcgatccaagcacagaagttggatggatgatgttgttctgtgcagagaaggaataaccggacaagtgactagcatcccct

SEQ ID NO: 109615 - DNA, 775 bp, Oryza sativa
cctgcagccctgcgaggaggaaggagtgcggccatgcgggatggggaggtggatggacgaaaaatagtcggaagccttacgtattttataattattaggttagatatagatatattacatctaaactccgaccaatgtctctttaatccttcatattcatatctatcggttatatatccgatcgatccaaattccatcggtatcggttggacacagaatactatatcacccctgtggtcgattggccccgtgatctaatcttctcgtttttaccttgttagttgcaagatcaaactaactagcatgttcctaacccgattttgataggacctatactagagtgaagcaaatatcttaggccttcgtgtgtgcgacaaattttgcgtcaatgaatctcagagcatattcaacggtacgtatatgggtgtattatgcaaccgcttgcacaaaacttgctattagcagaatgcattatgcagtcatgaacttggctttaggactgcataattgcatttattatgaagtaaaactagtgttattccggttattctgcttatgtgctgatgcttcgatgatccttcggtgattttacctagttttctgatgattgttttaaaatttacatcaatattgttattctgcttgtgtgctgagtcccatatgattatttggttttttccccagttttctggtgctttgttttaaaaattgcaacaaattcggtcaagatttgtccgatatttctgaaattcgtccatttcagttgtgccgaaat

SEQ ID NO: 109616 - DNA, 1024 bp, Oryza sativa
caaatgtacaggtgcaaggtatttgtactctctctcaaattaaataatctttggcatggtggcttacccttacccctgattcccacgagacactgcttctccttgccttgggtggttgaaagacagaacagcaattagagcaccaatcatccaatctttattcaacttttattccggaagttttcaaatgattttataaaagaaaagccaagtttctcaaatgattcactcagtctctctaagtgtatcaatatgaattcctcaccatttttttttgccgttttgattcctactctaaggtttgatatatggagctcggaagagatcaaacatagcatacttgcatttacatttattactaagtcaaaaacttagagtaaaatagatgactaaacatactcaagatcaagatcgtgcaaagtgtgtgatatatggtgaaagtcgaatatgaagaaaaagtaaagaaaatgcttctcctttgtgcttacttccttctcccaaaaatccttcttttattaataaggagagggcatggctttttccttctttttttctttatcatgcttatgcttgagagagcataactttatatattttttttcataaccatgcctttccctcccttcttctttctcttcttgttttttcaaaaaggattttctttttaggagaagaaagcgcataaaagcatggagaatttattttggtggtagtatggaaatggaatggataattgctagctcccagtgtaggagtttagcatgtgcatatacgtgggtgtatgatcttgatcatagagcatgagaagtatgtacacaagtcacaaaaatttgacaaagttcaatggaatagcaagtaaccaaaatgtatatggtttacatcaatgatgtcacatttttggctctggtaggaatttatatcacatgagatactttcaaatttaaaattttgaaaaacagaatatccggaattcaagtcaaacgaggactagaatcatagcaactcttatttaccatctcatatc

SEQ ID NO: 109617 - DNA, 946 bp, Oryza sativa
cagatcccaaacaaccctttaagcatgttgatcctatttaaagctattatttctattcaactatcgcatttattttcgaatgtcaatgggtggaattaccctatcctttgttatagcccttttgttcttgattactttattccttgataccttgggttataataatttgactggttgaactttattatattggttcaactagatattagatataattgcttagccctgcttagaaacattagcacactattgggataactataattcacttttatttcatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcgggtgtcgcgtcccaaaacgactctaaaatacatcctcgaaattatgcctagaataattaaaatccatgtgaaagcctccaacaattaaaatgtgcaaagttaaaagtcaaataaggcttggaggatttttgtatatttcctaaaagcctaaaatgtgtaaataaattttagtggaattttcagagcacaaataataattaagaagaaataaacaaagttaaaatggttttataaaaagaaaagccctaaaaagtcttttcccccccccttccccctcttgggccggctcggcccagccccctccctctctcttctctccctcgcggcccatccggccttcccccgcgcgcgcgccgctgacgggcgggcccgcccgccaccctcgctgacggggggggcccacgtcatcccctacctcgcgccgctcccgccgccttggccgtgc

SEQ ID NO: 109618 - DNA, 587 bp, Oryza sativa
ggctcggggcgggcgatgtgacgggcggcgacgcgacgggcgacgacgcgacggcagcgcacggggctcggggcggtgacgcgacgggtggtgacacgacgggcggcgatgcgatggcggcgacgcgacgggcggcgatgcgacggcgtcgcatagggctcggggcggcgacgcgacggcgacggcaacggcgatggcgacggcggcacggggctcgaggcggcgacggcaacggcgcgacggcgacggcgatggtgacggcggcgcgcggctcgaggcggcgacgcgacggcgcgacggcgacggagatggcgatggcggcgcggggctcgagacggcgacggcgacggtgtgcggcgatggcgatggcggcgcggggctcgagacggcgacgcgacagcgcgcggcgataggacggcggcgcggggctcgagacggtgacgcgatggcgcgcggcgatgggacggccgcgcggcggggtgcaggcgcgaggcagaggagggggcagagctaggggacctctgtcacgtcctgataaattcatcccgaaataaaaatcattttctaaaaggaataatagaattaat

SEQ ID NO: 109619 - DNA, 931 bp, Oryza sativa
ttattccggaagttttcaaatgattttgcaaagaaaaccaagttcctcaaatgattcactcagtctctccaaatgtatcacaatgaattcctcaccaattgtgctttttgattcctactctaaggttttaatatgtggagctcggcagggatcaaacatggaatacatgcattcacatttattactaagtcaaaagcttagactaaagcagaaaactaaacatactcaagatcaagatcatgcaatgtgtgtgtgatatatggtggaaatggtttatgaaggaaaataaagaaaatgcttctcctttgtgcctacttcattctcccaaaaatccttcttttattgattaggagagggcatgattacatttttcttcaacatcatgctcatgcttgatggagcataactttattatttttctttcttttcataatcatgcctttccctcctctctttctttttcaaaaaggatttttctttttaggagaagaaagcacatgaaagcatggagaatttattttggtggtaatatgaaaatggaatggaatattgcttagctcctagtgtaggagtttagcatgtgcatatatgtggatgtatgatcttgatcatagagcatgagaagtatctacacaagtcacaagagtttgacaaagttcaatggaatggcaagtaaccaaaatgtatatggtttaatcatgatagcacatttttggctttggcaggaatttttattaaattcggaactgtcaattttatcattttgaaaaacaaaacatccggaattcaaatcaaattagtatcaggatcatagcaattcttatttactatctcatatctcgcagcaacttagacttacatctgcaagtgcagctcatttacctcaagttcccggataattattggctacttatatttaacctttgagaga

SEQ ID NO: 109620 - DNA, 1238 bp, Oryza sativa
acttttgtgccttctggaaagctgttggttggcatagatttactgtggtagatgagcctggttctcgtctacttactttgcaatttttgtgcactttgaaagaaatagaagatggaatttccttttgctttttccataaataatacacacttacatggaaaggattaagtacacttcttggttttcacgattcctgtaaatcaatctccagaaattgaatttttaggttcgagaaaaataggttttgggaagatatttgtggtgctccaatttgcacgaaagctaggacgaatgacgtccataattctacacttaggctcatgcacaaatggattgttatgactttgtttcctagaggtgatcttagacccattaggggggatgaattaattatcttgtttgccatggttagaaagatcaaagttgctcctgtcaaatgtatgataaggcaatggttagaaagtataagattttttgctcctgttgagtgcacttccttgattactcggatagcaaagggactgggggtcatcaatgaccagattgcttatatcttggccgcttgtccctgtattgataagaattatctagtgcaagggcacattcttaaacatggagtagatggatctttgatatactttttccccggttgtacaaatgaaatcccgctgcctaatgcggggtatcatttgtacaacttccataaactaaccattcccctgcatatcatagaagaatctcgtgtaggtggaacatacagggagacacgcaacgtggcaagaaaggaacgagaaggttcatcatcctcaacaccgtgcagatgtatgaggcaggttgggaggcaacttgggatgcgcccggatggacccaagctccacgccacaacatcggagtctcaagctggacaagtgccagtgaggaccggtggcgtgcacctcatgacatacagtgggggacaaccaaccctccagattaagcagtatgcctccatccccaagtgaatggcgctcaagttcctctcgttgggtcttgagtgaaatcaccagcagaatgtataccctcgatgtgcagacgggagatatccaaaacaacctcgcggaacacatagcacagacgcaagaatggtaacagactgctgatgctcagttcgccaacatcaacaacatacatgatgcagtacagcccgacgaccttcaagcatactttcgctttcaggggttcaatcattatcaaggacc

SEQ ID NO: 109621 - DNA, 2475 bp, Oryza sativa
gcagtcgcggagtgcgggtaaagtgtacatccactgcaatgtgagtaaaccaaatctattcgaatagctgtgctcgcagttattgagcaccgggacatgtattacacttggctagactctaaattcttaacttgtgtgggatgagatactgcatgaagattttttttatgctgatggagccacttcctaagaggagggaaggtggacgtcctcagaaaaccatgacgactcaatggcgggaagctatccttgggatcacaatggatggtggacagaactgtcgttgtctaatgtgaacattggtattaaaacttgatcagtctatgataggtcttaggcttgtgaaaagaattacaaaacttgctttgcgcaaaagaaccatagccattctttgaataccctctatcatgtgcattgttgctgtggtgacttgctgagtacggttggtactcaccctttcaatatacaaactgaatcagaggtaggagttgaagcttcggaggatccctacgcttactaccaggagggtgatgaagacgatggcgctcagtaggtcttagttacggtcgttggctgtggcaatggcgtgccgctgctttaactccgctgccttatctacttctacttttggaatgtattccggaccgttcggtcctatgttctaagactatgcctgcgggcctatgatgtaataattcgcactagactctcgtgtatgtgcacttggtatttcagctatgaactcgtgagtaccagactacttgatccagggaaatggtactgtttacacgattgattcctgttataaaaacgggggtccacatacatataccttgcacctatatctttgagatatgcagcatagtagcaactcctgatcaacaaccaagtcttttgtttcctttcgtcctttactcaggacgagcaaaggttcaagcttggggggttttgttgacggtcgttatcgatcagtttcaaccgtcaatactaccaaaacagaggagaactagtgatgcttgcaatgcataaatatgttagaatataaatattccactagtattaggtatactaacattttgtagagaatgacaaaaaaatggaggagaatcgacatcaactcaaacgataaatcaatcggacgatgtcaagaatcagacttatgtatgaatggggcacgaagtcagaattgacatgatgaattgggccaaaattcacaagtctgcagagaaggatcacagaggtggccgccagccaaaattgggctggattgggccggccccaggttcggccgaacctccctcatcgccgctggatgcagggtttcttctggacggtgtggattagcttccaatgatggttggagggtattttcgacattccaactgtcacaaccgtcattgggaggctatataaacccctcaccttctcacttcactcacacacctcaagcaatagctctctcatttctctcaagtttagtttagtagtatctagctggtggaaaagaaatagagtagaaatcaggagtccggaagccttcggaagagttcgggtatggctctagtagcttttctcttctcttttgtaagctttgtagttttaatagaatactcttctaaatacatttatggtattgaaatacttttcgagtatatgagtacctagtttacattatgttcatgttatactaaatatacggctagcttatctgggagatgctttggtgcttatacaattactctatgtcatgacgatgatattagagtagtatctgctagtttagacgtggtgtctagattacgggatatcattatttggggttatatattgcggatgagaggtgggccgttgatggtgacagctcagtatgggtattcctccgcgccggtatataatcctaagttaattccctggggagggtatttctccgtatttagccccggttgtatggtcatgacgggctgtcgtaaggaactcggcagtcaggggtggcttctcgaagtaccaggaggacatcggatagagggtattagctagtatatcggttaactagtgtcacaccctaaaaattcaaaatatataaattgttgtttaaatggaatttttagaattaattttaaaagcctagaagagaagatctaattttaattaataaattccaatataaaatggggccagataaaatttcattaaatactttgcttaattctataattcctagatttttctgggatttatttgagctaagaaagtatttttaataaatggaattgcatttaagaaataatttaaattgaaaaagggtttaaaaagtctcttttggctttgggccgaaagtcggcccaaaatctcttttttttttttcctcggcccagccgggccagttcgccgggggggggggggcgtcgccgctgacaggtgggggcccacctgtcagggccatcgtttaccttcggccgccgccgccgaaaccct

SEQ ID NO: 109622 - DNA, 805 bp, Oryza sativa
ttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagcaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccaggatgcaccttttggctgactcagactaggttgcggtagttcagtgatgcttccgttctagaacttctcatgattcatatcttcggagtcaacctcggacaagttatcaacttcatgtcatgcgtcgtaacctgcttgtcattactaggataccatgcttgttatttgcttctaactcgccaccaactgcctcatattagcttccctggtctccgggtgatagctacttctgctatttgatgcaagggtcgataactttacctttgaattatgcttcccaagagagccaacttatcctacttgttatactttgacgtcttcccaaatggcttta

SEQ ID NO: 109623 - DNA, 2521 bp, Oryza sativa
gactaattcgcgagacgaatcttttgagtctaattacgccatgattttgacaatgtgatgctacagtaaacttttgataattatggattaattaggcttaaaaaaatcgtctcgcgaattagctctcatttatgaaattagtttttttattagtctatgtttaatactctaaattagtgtccaaacatccgatgtgacatgggctaaaaagttttagccccatctaaacacccctaatgcaaaaggagagagtttctgtccaccagcacagagaaaactattcctgaagaaccaggacagaaaacccagaacacccatgtcttgtgtcttctctaccgctgcttccttgctgaaccgatagatgctgcccgtccatgccaaaacatctccctcccacaatctcccattaaagtccaattagaaattatgtatttggaagatgccatcctatttaatttagagttcattgtaatgataacaaaataataatactatataagacattttattagcaccacgtaaaaacattttctttagtttgtaaggtattccctcaatttcgtaatacagggcccgcctataattattcttttgcagttttttcaacatgtaatgccttataccaaagcttgttttaatgctatattatcaccattttatccctcaagtggtactactgttagttgttattgttgtggctaagcagtactactatagaaaagatagcaatgtcattttatccttttgtgttgtactgttgttagcttttaaaatttcttgatctatgtacccagctgatattgccatatattatgaaatggagggagtagaggatagaaacctagaacggtactttccattaattcagtctgttgctcttaagatgaaataaagttggtaataggcaaatagcaaaattagccaaaagcgcacatgatgaccttttaagaacatattccatgttctgcacattatgcacaagtcaaaatatgaagaataaacacatggaacaaatccttacaattgagacatctgatgaggtaacttgtcttgttcatgaaagccgacagtatcagccttgaccctaagcaaataccacacatcttaataaagttagcatgttgctgattcaaatcaatttaaaaagcatagcacgatattcaataatgaaaaggatgcttagtttgacagtaatatccacaatgttttcagcaggttatattatttgttcttttaccctaaaaagcatacagtttttttaataagttaaaagtattgtcctgacccctgatatatgagcacaattaatgcgagaaaaaaaacacttaagcctacagtaacaataagtcaacatgttagatgcagctcatggattggcaataccaaacaacaaagaatgcataattggactatgggagcagatgtaagcatgaataaaaatgagatgaatggtgcaggtgtacaatgcgcaattaccactgcaatctattctagcttagacatgggtacatgttaatctgttttggtatacaagcaagtgattgccaaagttaataaatgactggaatactcatgccgccataggagcaataaaaatgaggggacaagacatgacgcggtacattacttattgatgctctcttagataaatgcctgtgtaatgggactatgggagctggactaaactatcgggaacacgaggcaatcagtgtgacggttgtgagatacgaaggctgtgtttagatccaaacttacaacttttttcatcacatcaacttgtcatacacacaacttttcagtcacattgtaacaattttaacccaaactttcaactttggaaggaactaaacacagtcgaaacaatgaaggcaaaaccatgaaactaaaacatttagtatcctatatatctataattctatatatgaagttcatcctcactaactgtagttaatgttatttttctcatctctcattaagccacatcactttaattatttgtaatccttggatgattgatctatggtccaaattatctccctcattttctcctcttatgaaatcatatcacctcagttttgcctttagatgattaatctatattatctcccttatttcccttctctcattgagccacatcatcatagttttgcttttaaatgatcaatctatacataattcaaattgttataatcacatcatcttaactgtttattgtttttttttcaatagtcagtcaaagatgaaaattatataaagtcatctagctatcttacatgttatgtctactattatcatacaaaattcccacaccaatgcgcagtagttattaataagatcatgccatcaagcacagcattgtcgaaagtaaaaggcatagaaggtttcacacataaacaagattataacgcaagattgaaagcataggaaactgcaagcaacgttatcaaacatctaccacttccagcaggacaaaataaactaaggaagacatcatacatggttgaatcttcctccttgactg

SEQ ID NO: 109624 - DNA, 637 bp, Oryza sativa
agtatatgtatggagtatgtaccgattgagataaggtgtagttatacttgcaattgcaagataccactgcacataattttgaccgtccgtttgtaacttgtatgattaatggttcagatcaaatgctacagtaatcatgcgaataatactccgtgctgtactgtatgcgtcgtacagtatataatctagacttttcgatttgcatccaacaacatgcacttttactgcttaagttggagtcataatagtgactgcagctgatccgaatccagtagctacatcctactagatttttgttttgtttagattactgggaaaaaacatatgatctatttaatcgtataggtaaattaaatataaaaataaacttaacaaatagcttaaaacaattgatctaaataatataacagaaaaatatatttttagtatgtattttttaaaacacatagaaaataatctacttttaataacccgataaataagctaagtcattccaccccataactcattttgttataaatacctacccctattcagttttgtcgcaaaaaccacttcaatgcgcttgtgtttaacccgaataacatgtttttcataaactgtgagcgtcaatatgatctttattaaattaaatatt

SEQ ID NO: 109625 - DNA, 636 bp, Oryza sativa
atctgcatgttaataaaaaaagagttgtgcctgagagaagctatgatgtccacagtagctagaatgttttcgcacgaaacatcgtttagttgttccggagggctgaagttcttgaactgcaattcaaaaactttggagagctgatacattgaaggttctttttttctaattaagatgtggattgtaccttagttttcattagcactagcacgtttttttaaaatgctaaacaatgtgtatcataaaaaaaactttctatataaaagttgctttaaaatatcaaataaatataatttttaaatttgtaataattaaaactcaactataattgcgctaatgactttctcgttttgtgtgctaactttcgtttgatgatgtaaaatgaagttagtgcacacaaagcgaaaagtaagaaagtaaattttataactcatatccactattttgtcatataattctctcgcaaaaacttgcggggttcttatctagttaatacatgatgaggtgatcgagattagaaataagtatgggaagggtgcaggtctcagagggctgatgcgatgatggggcctatcagagttagtaatggaataaaactcatcttttttagctatatttatgacaaaatttacacct

SEQ ID NO: 109626 - DNA, 943 bp, Oryza sativa
ccaaaaatcatgtttggtgcttttaaactttttcattccggtgaaaaacatcgcacccacctatggcaatattagcattaattgacaaaagttcgccgcgcgaatcacgaagtgattttttgccacgaatgcacccaacacactccaatatgtccaaaaatcatgttttggtgctttttgaactttttcattccggtgaaaaacatcgcacccacctatggcaatattggcattaattgacaaaagttcgccgcgcgaatcacgaagtgattttttgccacgaacgcacccaacacactccaatatgtcgagaaatcaagttttggtgctttttgaactttttcattccggtgaaaaacatcgcacccacctataccaatattggcagtaattgacaaaagttcgccgcgcgaatcatgaagtgattttttgccacgaacgcacccaacacagtccaatatgtccaaaaatcatgttttggtgctttttgaactttttcattccggtgaaaaacatcgcaccaacgtgtgccaagatatggcaatattggcattaattgacaaaagttcgccgcgcgaatcacgaagtgattttttgccatgaatgcacccaacacactccaatatgtccaaaaatcatgttttggtgctttttgaactttttcattccggtgaaaaacatcgcacccacctatgccaatattggtagtaattgacaaaagttcgccgcgcgaatcacgaagtgatattttgccacgaatgcacccaacacactccaatatgtccaaaaatcatgttttggtgctttttgaactttttcattccagtctaaaacatcgcacccacctatgccaatattggcagtaattgacaaaagttcgctgcgagaatcacgaagcgattttcattccggtgaaaaacatcgcacccacctatgccaatat

SEQ ID NO: 109627 - DNA, 827 bp, Oryza sativa
gactttttcattccggtgaaaaacatcgcacccacctatgccaatattggcagtaattgacaaaagttcgccgcgtgaatcacgaagtgattttcattccggtgaaaaacatcgcacccacctatgccaatattggctgtaattgacaaaagttcgccgcgcgaatcacgaagtgatattttgccacgaatgcacccaacacactccaatatgtccaaaaatcatgttttggtgctttttgaacttttttattccggtcaaaaacatcgcaaccacgtgtgccaatattggtagtaattgacaaaagttcagcgcgcgaatcacgaagtgatattttgccacgaatgcacccaacacactccaatatgtccaaaaatcatgttttggtgctttttgaactttttcattccggtgaaaaacatcgcacccacctatgccaatattggctgtaattgacaaaagttcgccgcgcgaatcacgaagtgatattttgccacgaatgcacccaacacactccaatatgtccaaaaatcatgttttggtgctttttgaacttttttattccggtcaaaaacatcgcaaccacgtgtgccaatattggtagtaattgacaaaagttcagcgcgcgaatcacgaagtgatattttgccacgaatgcacccaacacactccaatatgtccaaaaatcatgttttggtgctttttgaactttttcattccggtgaaaaacatcgcacccacctatgccaatattggctgtaattgacaaaagttcgccgcgcgaatcacgaagtgatattttgccacgaatgcacccaacacactcc

SEQ ID NO: 109628 - DNA, 1076 bp, Oryza sativa
tatgccaatattggctgtaattgacaaaagttccccgcgcgaatcaggaagtgatattttgccacgaatgcacccaacacgctccaatatgtccaaaaatcatgttttggtgctttttgaacttttttattccggtcaaaaacatcgcaaccacgtgtgccaatattggtagtaattgacaaaagttcagcgcgcgaatcacgaagtgatattttgccacgaatgcacccaacacactccaatatgtccaaaaatcatgttttggtgctttttgaactttttcattccggtgaaaaacatcgcacccacctatgccaatattggctgtaattgacaaaagttcgccgcgcgaatcacgaagtgatattttgccacgaatgcacccaacacactccaatatgtccaaaaatcatgttttggtgctttttgaacttttttattccggtcaaaaacatcgcaaccacgtgtgccaatattggtagtaattgacaaaagttcagcgcgcgaatcacgaagtgatattttgccacgaatgcacccaacacactccaatatgtccaaaaatcatgttttggtgctttttgaactttttcattccggtgaaaaacatcgcacccacctatgccaatattggctgtaattgacaaaagttcgccgcgcgaatcacgaagtgatattttgccacgaatgcacccaacacactccaatatgtccaaaaatcatgttttggtgctttttgaactttttcattccggtctaaaacatcgcacccacctatggcaatattggcattaattgacaaaagttcgccgcgcgaatcacgaagtgattttttgccacgaatgcacccaacacactccaatatgtccaaaaatcatgttttggtgctttttgaactttttcattccggtgaaaaacatcgcacccacctatgccaatattggcagtaattgacaaaagttcgccgcgcgaatcacgaagtgatattttgccacgaatgcacccaacacactccaatatggcccaaaatcatgtttttggggctttttgaactttttcattccggtttaaaacat

SEQ ID NO: 109629 - DNA, 827 bp, Oryza sativa
acttttgtcaattactgccaatattggcataggtgggtgccatgtttttcaccggaatgaaaaattcaaaaagcaccaaaacatgatttctggacatattggagtgtgttgggtgcgttcgtggcaaaatatcacttcgtgattcgcgcggcgaacttttgtctattactgccaatattggcataggtgggtgcgatgtttttcaccggaatgaaaaagttcaaaaagcaccaaaacatgatttttgaacatattggagtgtgttgggtgcattcgtggtaaaaaatcactccgtgattcgcgcggcgaacttttgtcaattaatgccaatactgccatatattggcacacgtgggtgtgatgtttttcaccggaatgaaaaagttcaaaaagcaccaaaacatgatttttggaaatattggagtgtgttgggtgcattcgtggcaaaaaatcacttcgtgattcgcgcggcgaacttttgtcaattaatgtcaatattgccatatattggcacacgtgggtgcgttgtttttcaacggaatgaaaaagtccaaaaagcaccaaaacatgatttttggacatattggtgtgtgttgggtgcgttcgtggcaaaaactcacttcgtgattcgcgcggcgaacttttgtgaagtaatgccaatattgccataggtgggtgcgatgttttagactggaatgaaaaagttgaaaaagccccaaaacatgatttttggacatattggagtgtgttgggtgcattcgtggcaaaatatcccttcgtgattcacgcggcgaacttttgtcaattactaccaatattggcataag

SEQ ID NO: 109630 - DNA, 562 bp, Oryza sativa
gaaaaattcaaaaaacaccaaaacatgatgtttggacatatggagtgtgttgggtgcatgatgcgaaccccattgggtttgtggcccgatctttcgtgacaggtaagggataactcgattagatgaagtcaaccttcacggcccgactacaactgtccaaaacgctgatggcttacaccgatacaccgtctccaatggtcgccgcgaacttgtggtgcgcgtcaacccggccacgaggacactcgtcctgcaagcaatcgaagaacaagcaagaacaagtaggacaagcactgaaattgctacataaagatgaaagtttcactatcaaacacaatatggtggggttccgattacaggcagacgggcggtttagccaacacgcgcgctgcgagccggtggcaagaagctatctctatcatcaaaacccgcctgttcttggcggcgactcgaggtataaaaagaggggaagaacgaccatagggtcgtgctccaaccctaggacgcgcccctaatgggcccaacatggatacacagcccattgggccaaaagagatgacgcagc

SEQ ID NO: 109631 - DNA, 782 bp, Oryza sativa
gtttttcaccggaatgaaaaagttcaaaagcaccaaaacatgatttttggacatattggagtgtgttgggtgcattcgtggcaaaatatcacttcgtgattcgcgcggcgaacttttgtcaattactgaccaatattggcataggtgggtgcgatgtttttcaccggaatgaaaaagttcaaaaagcaccaaaacatgatttttggaaatattggagtgtgttgggtgcattcgtggcaaaaaatcacttcgtgattcgcgcggcgaacttttgtcaattaatgtcaatattgccatatattggcacacgtgggtgcgttgtttttcaacggaatgaaaaagtccaaaaagcaccaaaacatgatttttggacatattggtgtgtgttgggtgcgttcgtggcaaaaactcacttcgtgattcgcgcggcgaacttttgtgaagtaatgccaatattgccataggtgggtgcgatgttttagactggaatgaaaaagttgaaaaagcaccaaaacatgatttttggacatattggagtgtgttgggtgcattcgtggcaaaatatcgcttcgtgattcacgcggcgaacttttgtcaattactaccaatattggcataggtgggtgcgatgtttttcaccggaatgaaaaagttcaaaaagcaccaaaacatgatttttggacatattggactgtggttggtgcattcgtggaaaaaaattactacttgattcgcgcggcgaactttggtcaattactgccaatattggcataggagggtgc

SEQ ID NO: 109632 - DNA, 755 bp, Oryza sativa
cattgatacattctttgattccttttatattatatactccttgatagcatattgatagtaattcattgggagtacataggaattgattggattgggttctttagggttgatcactactttgttaggattgcattatctactgtatgtattctttggttgattgatactcgctacatgcagcgcctataccacccatgcgctatacacaccgtaaggacgactctatgccgagacatatttcagtccgtcacactctgcagatcatctcggtcaaaataaagggaataagagggggcttacagtggccgatcaatgtgtttggtctcattgctgcgcgcgacacgattgaccgcaaccgcattatgatcttcaaccgcaccagggataactgccaaacaattactaaagaggtgcactttatttcctattgtacatcgttttatatttcttccttttgcataattaaatcatgatttgtgcgtggacacacattgtgctactagtagtttttactatttatatatagagatatttgttgcactttattccttggtttcttcatatcaaattagcccacctcaaatggacttttagaagactacttatacatggtgatacagtttgcttgcttctagtaatgcattgccatggctaagtataggatttccacatttgttacttatatcagaatcataaagacagctcaatttacatagaaaaccattcctaccataactaaacatactaatccgtat

SEQ ID NO: 109633 - DNA, 710 bp, Oryza sativa
gaaaccgcgagacgaatcttttgagcccaattaatccgtcattagcgcatgtgggttaccgtaacatttatggctaatcatggactaattgggctcaaaagattcgcctcgcgatttttcccataactgtgcaattagttttttaatttatttatatttaatactctatacatgtgtctaaagattcgatgtgatgtttttaagaaaaagtttttgggaactaaacagggcctaggtttccaaccccttttcctcgtattccgtacacacgttttttaaactgttaaacggtgtgtttttatgcaaaaagtttctatatgaatgtttcttaaaaaaaattatattgatccattttttttaaaaaaatagctaatatttaattaatcacgcgctaatacctagggcatgggttaacaacctctatacacgaacaaagcctaaatggttagtcttgtgattgtccagactaatggaattttcctatagctataggcctcaagtgttagaacacacacataaatagataaaaagacaaatataccctaaaaatttatatgcaggatatttgggaggaagatcagatgaatttacaccattagatcaaatatactggtagtatatactagcagtagaatgtaccgtaaaagtcctcttatatataatgtgtagtgcaataggaagtgtgtctggtggctaacttagtgcttgat

SEQ ID NO: 109634 - DNA, 1988 bp, Oryza sativa
tcaattcatggggattttagaggattttatacatgaggtcatacctcatgttaatgacctcatggaaaactttcctttggtctatctctctccaaattcttatactttcatatggaacatttgaacaacaatattcgcacaattcttgtattttcaatttataaaataaactagatatgccatctcgattcctacgtttttagggcccctttgatgaatcgcaggattaggaaaacatacgattttgattggaatgtaagtgtaaaacagaggattgtaaaacatagtaaaaacacattaatgaccgtttgattgaaccgtaggacaaacacatgaattggatgagagagatggactcaaaggaacgctaccaagagattgaagctcttggtaaattacctccaaaatctctttaggattctccattccataaggatttcaaaggattaggccccctttgaatcacaggaatgaaaaaacgggggaataggaaaaacataggattctgataggaatacaagtgtaaaacagaggattgcaaaacacaggaaaaacataggaatgaccgtttgattgacccgcaggaaaaacacaggaatttgaggagagagaaagactcaaaagatttttaacatgaggtagaacctcatgttaaatttccttcaaaatttgcatgggaagaggcattccataggaattttataggattccataggattcattcctttgattcaaagggctatataggaaaaattcctataggaattaaatcctttaaaattcctatgaatttcctttgaatcaaagggggccttagataggattcaatcctttgtttcaaagggctttataggaaattttcctataggattgaaatcctcccaaattcttatgttttttctgcaaatcaaatgggccctgaatcgtagtaataaaaaaacgggggaatatgaaaaatataggattctaataggaatgcaagtgcaaaacagaagattgcaaaacgtaggaaaacacaggaataaccgtttgattgaactgcaggaaaaacacaagaattggataagagagatagactcaaaggaaagtttccaagaggtcggagttcttgctaaatttcctccaaaatctctataggattgtccattccatagaaattttcaaaggatactatgggaatcctttgcttcaaatggcttcataggaaatttttctataggattgaaatccttcaaaattcctatgattttccaccaaatcaaaggggcccttactgtttctatgttttttaattcctgcgtttgaaaggagcccaaacatgagctccaaccccatgtttttatttccttggaaaattacaaagcaatttctcactactctcactgaatctaaaggctcatttggaacacatgattcttaaacacactataatcgtaaaaaaacaaacataattgtactaccctagcatctcaaatcgtatgaattaataaagcatgagagaactacagaaatgattgtttagatgaaacacagaaaaacaatagaaatcagaagagaggtaaactaagtattatttttcaacaggttggacctcatgttaaaacttatctagaatccccatgttcatttttttgccaaaccaaaactagactagcatttggttataggcagggcaggctagctagaacgggtgatagtatatactccgtatcattgagccattgccattgctagtcgctgtttgtttgcgtatgattgagccattgcggcattgccaatctctgtttgtttgttacgttcgtgcagtggcatgctagcttgtcagtacatatactagctagctagtagcttccaagtatatatggatgggctccatttctttctccttgattcatggtcatggcctaacttcctctggtttttcgttcaacctgcttccgttcttttccgattgttaatactccctccatcctaaaatgtttgacgcc

SEQ ID NO: 109635 - DNA, 2763 bp, Oryza sativa
attcatcaccccgcattggcttaatattttagacatgtatgttgagctaaacattaaactaaatcattgcttctaataatagaaaataaatctaaattatttaatttataatagattttggagtaaaatatggctcgccacgattaaatcaaccaaccaaaccataacgttcctaacatttagcatgcgatacatatcctaagtttcaatcctaaaatgtcaagagtttactccttccgtttcaaaaaatatataaattttttttatcagaactgacacattttagtactatgaatttggataaatagtttgtccaagttcgtagtactatgatgtgttatatttaaccaaaatcctttatattttgagacaaagaaagtacatgggatacaattattttgtcccttattaacaactctgtagtagcattgttactctatccgttttaaaatatatcaagctagtataagatgagatacattttgaatctgaggatacaatgaatatgttactattttaagaggaagatagtagtacgcaggagtacttcaactacttctgttctacgaggtggattccagctctccctgtcgcaatctaaaggagccctttgtagtttgtacaggtcaggcctgcactctgcatgcagtgacaagcaagccagaactcttcattcagtattcactggtctctgctccctccccatgcagatgtgcccatgtcgatcttgatcgtccggttgcaaactctttgtcggactggccagcttcttgtcgctcctacgttttctaatctttcagaagccgtcagtctctctcctgtttcctatgaagcttgtgtcagcttgcacatcgttgttaggtatacttaatttagtttcagtattgctgctgctgtctctgcaggcgcagccatgctgtgaattgccgattgctgccttgctggtgtgcgagtctgaagcttatcttgatgcaatgcaagcctgttgtttcttgtgagatactagctgaaaagactttgattaattgagcagcaggagccaggcattattaagaggtgagtgagtccatgcatgtgacattccaagatctcacgcattaccgggagcgatatatagtttaacattcagagttgacaattttcagtcagggtcttgtcagataagatcgaccttcaacgcctacccaccaagcagatatactcccattgcatctgaatcctaggcagcgatgatagttcaccacaaatcttggctttatcatgcaaatgctgaacctgtaatgcagtaattcgttggaatgagcagaaagctagcacattattatggttcatgatcagcaatacgttgcgatgcaaaaatgtcattagcagcagcactgcatgcaggcataagaatctgcaataattttcgcaaggacatgagatcgatcgatggagagtggggctggggctatcccagcggaaagaggagcctcggctcgagatataattaagtggcgttgcatagcttttgcagagcagcaatgcctttgctttgtctgaggattcagtacagggctacctgtagccacaaactgtttactagttaggtgaccacactaatcgaacaaaccaagcaacaacaaaatacttctagttttaaaaagaaaaaaaattgttaatctcctcctactaatctatctgcatactgtcagagataactaacatgattaaattagcaggcaaaaatcattatcttaaacaaaattagcaggcaaaattctgcagcagattgctgaaaccctggggtttgctgctgcatttcaacctgcattttcgtttggaacacttgactgcaagcgacagaaaggcaaccgtggggtcggtcagcttcattagcggacgagcatttgaggagaccgtgcgccatgattgcaggcacaagctttgccatcgccaaactttaatttaatccctctctttctttctcttgtctgtctctctgcttaattagcgacctggattagtgtttctttcgctgcacgcacgtacgtattttctgtagatgaatccctgcacaagtgtttaatcagtttgttttaatttttgtgtttctttctcgctgttgttccatgtgtgatcatcatatgtggcatcttcctttaatcatgagaagagaagagaacagagcactgcgttcttgagctgagaacttctcatttcatcgcacatgtacgttaattttgggttactttgggctgcttgtctgaactttctgaaccatccggagctgtccggtctgattactggctggtcgaaccgtccatctttaatcgttactatttctgagttgtactgaagattataaaaaaaatgtgtattcattagtagatcgacgacaatgctaatgaagtaatgatcggtgttcagtaacccaccagcctaactaatttggccaaggaaaaaaaattctctttagtttagcagacgtggcaaaattaattaggagtagcagctagcgcaggtgaatgcacacgttgggctagccctatacgaaatatacaaacacgaaatgaagtctaatgaagattgaaaaattatgacatactccctccgtctctaaatataagagattgtactagaatatatcacatccaaccaaaatctcttatatttagagacggaggaaatatacaaacaaaaaaatcattagatatttttaattaagtttaattattgtaaacttaaaaatgaatttatataatattttaaaattaattttta

SEQ ID NO: 109636 - DNA, 2279 bp, Oryza sativa
  unsure (1)..(2279): unsure at all n locations
cagtgaaggcaaacagttttaagcagtaattactgggtggtgaagtgaagagtaagactgaaagcagggacctaatggaggcaggggcttttgggcatgcaaaggtcagaatgctaatcactacaactagtagcaagcaaagcacatttgtgaattatgatcactagggtgatggggctctactctgcctgattggattaacagtggtggcttttctgggcatcagagggcactagctaatctagtgttgtggcaccagatcttgtctgcctgatgatactggtgtaaagtactccctccgtactcgtaaaggaagtcattttgaacagcgatacggtctccaaaacacaactttgactttttgtttctataaaaatatttattgaaaagtgatatatgtatacttttatgaaagtatttttcaagacaaatctatttatataactttttacattttcaaactcaacaatttgagagttattcatgatttatattcctaaggtttgacttaaacattgtcctaaacgacttcctttacgggtacggagggagtagagagtgtaatgaagcatagcacacatgcaacaaggagaggattagaaaaggagagaacactgaattatttgtgtagttgcatctctttttgcagagagataaaataaaagctgttttggcaatgtgggggaggatgtatctttgacctttgcttggccaagtggaattggggggtcaaaccaagtcagtctggtccaggaaacagagcagatagacatggtctttgagtcttcaagattggacagcactataattcctatttgtccatgcactgaacctgaattatgaaagccttgatcacagaaaagccttaattgtgaagccctgaaggctaaaaatgtaatgttatgctgccaatgtaaagctttcttgtgtaagataattacatgaaacattcttgtccctgcagtgaaggaaaaacaactgtggtccagatgagtgaatcagtgaagcacctagcttttggggagtaaaagtttcagtaattgatacttattaaatcatatcttcatgggcaatcatggaggcagtaaaataatgatcaacgggtcacatttgtgcagtatgcataatggtgaaaataacaaagccactacttaccaatcatggatcataatatttgcaatttgcaaatgtttaagcctccactctgagagcacctggttccatcagagctgacaactcctgatgtgtcaccttgcctttgcccaggccatcaacagcaatcaatcctacttacaaagcataggtcaaattaacttgtggttactagttagccaatgacaaagtacttttactggtcaatggctatctggttatccagtgacaaagtacttttacttgtcaattaggcaatagctaagaagaactactgagaatgaatggactagtccagaagatctataaaggagaagtaattgaagggatattctagcatctgttggctgtggcttaaggaatgtttgccacaagcacattgcactaagaccctgttcagctgttctgtctgagatgatgctgcttgatatctacgtgtaagtcattaggtcatcatctttccaagttgtccctaaaacctatctaactatctgctttattatgctctagtatagcccttgtaacctctgcatttattttgtgtgctctttttgtttatttgtggggatatgtaacctctgaaagttatagggggggactgaaatgtttcagaactacaggttaatcaggtacagcttgcaaatacctatccgaatagtaggaggaaaaccaggatctgagagagccccacgaaattataagacaatgctaaacaagttcaacagcatgaaatgccttgtattgcatctgaagagggaagaagttgatactgggattactgtaacatgaatgccttttagaagcaactgaggaagatcatacttaaaatacaacctcaccgattcataaatttgcatatcactgtttgtgcaccaccaactcttctatctccaaatgcgattactttcgataaaaagtttttgtaaaactaaagcaatggtgacctttgtaagtgacttcgaatcacatcctagatttttcacattttggtccttttaaaaaacttatttcgcaagtagatctctagaaaaacttatcccaaaaatggtcctttttagggcgccagagtggctggcnccnnccttgaacaacagctccagcctctttggcgccgtcccaccgccaac

SEQ ID NO: 109637 - DNA, 963 bp, Oryza sativa
aaaaattttgtaaaaggggttcatgtgcagcattgtaagagtttcatcaattggcatgcacattaaatttgtagttactaatccaacatggacatacctaattacatatgcaaaaacctctgaataaataaacagtcaataaatattggcacatgcctaagttgacactggcaaaccaattgcaatttgctttcattaaaaaagggtcaagagcaagctactgataaaaaatgccaccttcttatccctgtaaacaaaaacatgtgatgctcaattgcatacagcgcgtgcttactgctacagtgtgttgtctgtcagtgctcgcgtatgcaacctcatcccaatcataaaattcgattccacgacgaatgttgtggaaattgagcacatagcgcttgtgtaatcttacacgttgcgcgagtgaacttttaaccattccttataagtataggtggcaatcaaattaagcaacaaaaatgaagcatgccgatgatgtccaattcgattacgcacgaaagaatcgcgcgattaccacctgattgaaggttcccctgttcggttcacgagtacacgacgaggcatttgcagagcagagccgaattttgtgaaggcgtcatttacttcataatttcttttagaaaaaaaaaatgtaacatcacaagacgacaacctgaatgtcacgatctggacagcaacagcaaagggcagcgccaatccgcccccaaatcgccgcgcccacacgcacacgtcacccagatcggggccgccgcgaaccagatcgggggggagggagaaggaggtcgggtagtagcaggggagggaggggggcggggcgtacataccaaggtggtgcttggtgcgctcgacgaggttgcggcggtagagcgcgaggacgctggccatggcggcctcccgctccccggtctcctcgtcgtccgcgtcgggctccttcaccgcgaacga

SEQ ID NO: 109638 - DNA, 523 bp, Oryza sativa
aatcgtggtcgaccacaaatccaactgtccatttttttcattaaaaaaaaatcaccaaatccggatcttagcgataagccccacacgtacgcgccatgcatgtcagggcaagcaaaacgagagagcccctctctttctctgtaaaaaaaaacccaaaaaaatgaaaaagaaaaaaagcaggccacgtggcacctgtcgggctcagaccgactcgcaccgatgcaccgaccctcctccgtgacaaacgcccaccgacacggcgggccggccttcacctgggccccacacgtcagcgtcgttgtgtagaaggtgaaagcctcgtgcgatccgagcccgagccgaggcggctacagtgtgacgacgcgattttatcgcggagctcctataaataggcccccgcgaaaccctcgtaacccctcttctactatctctctctctcctccggccgcggctgctcccccccccccctttcgtcccccaaaatctccgcgcctccgagaagattccaccggcggcggacgac

SEQ ID NO: 109639 - DNA, 1587 bp, Oryza sativa
ccagtaagcagtatcgccctgctctacggcttcgcttgcaatttgcaatactgtggtgtcttttttttgttttgttttgtcgcgacaagtcagtagcgcgctgtagcggagtaaactactacagtagtatctcttcggcccacatgtctgacaggtgggcccggcggggtgtgcgggccatggaaaaggggaaaatatcgagattcctgaatccggtggtggggccgagcccgtgggaggcgaggccgccaccacgaccacgcagccagcgtgggaatcttctgggcccacctctggtcacgccacggacgcgcctcgtccacgtgacgtggcgccaagcgtgtggggtttgcttttgccgttgcccgttcacgcgcgccaacggctgcctcctcatgtctgtctttccctgtcttcctctatggtggggcactgctcttctacctacctactccctccgttttttaaaaaaaattcctaatattccaatgtaaatttaatagtgagtaaaaatgactaaaatacccccttattattaaataaaatagtaatagtgatagataggtaaagggtatttaagagataaaacttcttatttaatgtgcagacagtaggtaagatggtgaaagttgtttcctgtgagacaaaattcaaaccacataagttgagtattttttggatgggggaatgctccatccgttcgcggtacttcatccgttctaaaatgctaaatcaaactggataaattttaacaaatattacactagcaatatagttttgttaagtattacgtatattatatcattatatttgtattttaaaatacttttatgtgatattaatttttttagttgtttaataacatactataaaataaagtagtgatcaaagtatattagtaaaggccgtgtaaaaactatatgccttacaatttagaatgaatggagtataatacaaaagattatgtcattttctgtatattaagaaagtaacaacatttaatagttcaaaagaaaataggtaagagggtataaatgggaaataaaataatacaaagaagttgatatgtgaataaaataggtaaaatttgcttcagaacgctcaaagtttatgatttttattgtataatacccaaatagcttgtatttgttataggaatcacgaaaatatggtaattagctgttagacactgagcgtattgctttattgtatccggtccaaatggagagaatctttcaagaaagacaagtttgcccatagtgtatctttctttataaaccgatcaggtttagttcgctaacaactacaccagtgagaatgactgcatcgaggaagtgggaatggactgagcctggttcgaatgagaccgagccatcttacaagccgatggacacaagggcaaatatgtacttttcgtactgtttatctctctattgcaccggatataataaaataatgcattcacgcatccaacaattaattaccatgctttcatggtattctacagtaaatacatgttatttaggtgtcttgcaacgaaaatcgtgaactttgagtgctgctccctccgtcccataatataaggga

SEQ ID NO: 109640 - DNA, 1542 bp, Oryza sativa
caacactttgggtcaatatacacactccgtattcacccggtgcaacgcacgggcacttttgctagtctaaccaaaattaaactaatcatgcatgccgtcgaagcactgtacacatttagataaaacataatttatcactcaccaactacgactttaaatcatttcgagagctgtacagtagttagctttgacctcttcaattattttgttgagaaaaggaaaaaaaaggagatcgaagctgtgacggacagcgcgataatttgcatatattgtgtgcatgctgtgcgcttttggttgagttgctccatcccacgaacgactgtacttcggttcggtccaaccaaatctattcttatgtcttctcctccacagctatatattgtaaaccaccaatctcggccggcctccttgtattgtcaaccccaaattaaaattagtcaatcgatcagtaacccggccggccaatcccaaccacaacgaagtgattaatttattagcttcctttagtactccatccagccactattataagaaaaaggagttatatatatgatatgctatggttaggaaaaaaaactttgctagttccaaatcaaagttaactaaaagttaaaggagtatgtttttttggcgagaaattttaataaggtttggttacaatacagtgggaacatgcttttgcgaccaaccacatgaaaagaaaaaggttaatggaaacgaccgaaagctagcagcactggggacctagaaggctagaactcgatcgatcgacgcaggtcagaactcagaacaacctttttaatgtcttttgtttgggaatacacaagacattgatcaaagggctggtgctgctcttttatctcatactatgttagtcaaattcttatcctaacaaagataaatacattctacttatattttaaaatggagagactccaaattagagacattgatacaagggctagggctaattcattgctatttaatttaataaagtcaatttttgtagtttaataaggaatgcacgaatgttgtcttaattagatattagttaatatcctaatatattaaaatttggaaactttggatttatatatatcgttttagaaaatgttgctttcttcaaattagtattacatcttcgaaatagtgtgtatctacatctggaattatcatttaaaatcttaaatatgtgctcaaatctgtacaattcaaattttaatacaatagtattagtgtttagaccatctccacttaaatgatcatggaatattcagaatatttcgaaatatgctgcaatttatcctttccatttcaaaatatgggacgtattttgttttgtaaggttaaggcttaaactaaaattgattccttatttatatacttatatgatacaaaagtataatcatgcaaaattacttttgaagacgaatacaataacattaattttacttctcaaaaattatattataatagagtaattgtttatcaaagtcttgttctaacaaaataaaatacgctttactctattatataatataa

SEQ ID NO: 109641 - DNA, 929 bp, Oryza sativa
cgtagagatttttgaaagttatatacaagttacattatagttacagtataattacatgcaagttacaatataattacactacgattgtattgtaattacatctgtcaaatttttgagagaaaatttatcgacaaatatatagtaaaatcgaaaccagatataactagtcccccaacttacaaaactagtgcaaacgaggtccatctgcggtttggatggtggttttggctgacgtgacgcatacgtaactagtttgacttggtcctcatcctacgtaacggtgatgtggcgctagagcaaaatataaaaattaaaacaaaaaatgtggaactcacatgtcagtcagatctggagggaaagaagagcggcctctccgctctcaccacgcgtcgcgtgccactcctctcacgctgctcgccgcgcccgctgtcctcgttgcgttcctctccctcttgatctgctgccatcggcgttcttggagcccgcaagccacaggtggccggctgtcacccgcttggatgacgcagccgtgggagcgggggaggatggaagagtcccatctggtttttgggtgcaaggacgaaaataagactgggctacaaattgaaggatctcaagtgaacttattccttctaaggttcttccactatactaaggtttttggaccaacaacaaaccgaaggcccaatacaataatgtttgacatgcagtgcctttatgggctataattagttgggctgatgtaatattcaggccaataaattaactcgagcttcctgtaaaaaaaaagaaaaaaaggaagaaactatttcacctacttgagctcccagttgctcgctttagctgttacatcaggctctctaccgataattgtttttccattcctttgtttataaaactattgaaaaaaaaactgccaacgagtagaa

SEQ ID NO: 109642 - DNA, 710 bp, Oryza sativa
caggtaggcagagatggcgtcgaacagcatgttccgttgcaatgtactcggacacagtgatctgctcgtaggggttgaagtaggacatcgccatgggaaccaagctactgatgatgtacctagcctcctcatggacgtgctccggcatcgggaccaaagcaagccgacgccagccatagctgacccgaaccctacccacttctccacagaaaacgccatgactgcgcggtgcagccactacgtactcgcctagtcgcctaattaagcgtatctagctacttacactgtagctcccttcaatggttgccgttgtggatgggcttgcttaccgttgcttctgtggcggtgtggcctcggcttatataattggcgattgtggcgcgcaaatgatccctgccgtttcatcgtggaacaggaaaaaggtgacaacgcgcctcgtcgaagtttcgtcgaaccaagcgcgatgatgcgatttggcttactccacaggaaaagtaagtagtagtagaaattgcaaggggctcaaagaaaccacgagaagggactatatcaccgcgttgggtttaactattaatgacccgagctgaaccggtgggctagaccacggcaccacccaccaaccactggtggagaaaccatctttcgtcggtcggccgatttccacaatagtcccggatgcaataaaaaccggggctaaagatgatttttag

SEQ ID NO: 109643 - DNA, 663 bp, Oryza sativa
tcacagcaatgaactcaacctacacttgtctatcagattggtggaacaagtcaagtgcaatgacaccatgtgaaaacagaaagggagtattgggagctttgcttgttacgtggtggaatatccggcttgaaagaaacatgagggtcttccaggaccaacccaagaacaaggtggttttcttggtgatacaagacgtaaacgagctacccttagcgtttagtgctgataccctctaatgcggattttgatatgcaagttgctattcttggcgctgtagatatcctatttagtatgtactaaactagactctatttgttgcttcttctaatgtatttagctagcagatctcctgcctgctactttgaaaaaaaaaaaagaagataaacaaacatacaaaattagggattattgctccaataagtagggaatcagcaactaattgatattccactttaattctgtcagaattcattgtgctagatgaaggggaaaaaaaagacaaattgctcagattatttaacatgcttttgcggcccaatatatatatgaaacataattagttggcaccacgtcagataatctatcggatctggttcaaatttaatctttctagtatcctgttgtcattaacaggatttgtactgtgatggtctatagagtgta

SEQ ID NO: 109644 - DNA, 1348 bp, Oryza sativa
aagggtgagaaggaagttgagttgaagggctgataaggagaggagaaaaggaagatagttaaggatgcatgtatgactgttaggtccggaagtggtaggtagactggcagatgccagatagctgccctccttgctgcagtttaccaaatgcaaataccaatgactcggctcatctaacattactaggtaatgtaccaatttaatctgtggatcacaaaaacataagataagaccatgagctccaacactgattcaaccatatactcaagtaacttgcaagcataagcacagtagcattgttgcattaaccataaacagcagtaataaagagtatttgaactgatgaattctgcaaaatggattactacttacttacacaagacctagtatagtctacatgtccttgttgcaagctcaggggaaaacaatcaccgcaagcacagagacaattaagctctcaagagcagcacagaatgaatcaatagctaggactgttggttgctgttgttgttctatatggatcacagaacataaggctatgagctccaacactgattcaaccatttatactcaaataataggcacaatagcattgtttcattaaccataaccaacagtaaagagtatttggaccccaaaattctgcaaaaagattactacacaagacctgttctatttgtacatgttgttcttgctgtgctcacagaaaaccatatatataatatcagtaagaacacgaagactacaaataagttgtgaaagagcaacagctagctagcacgaatgttggttggtggtggtgttgttttggatgagggtatggatgagctgcagcagctgggtcctcatggccttgacgctgtcggcgttcacctccctcttcacggcctccaaccaatcggaatcggaattggaatggcgggcgcgggtgggccaccagttgcagatggccctggccaccgctagcacgaagacgccgcagtcgtagccgtttgtctgcctgggcgtggggccctcgatgagcgggatcgcggaggcggggagcagcgggcggagcacggcggcgaggcggcgcgcggagggcaggttggtgggtgggaggctgtcgtggtggacgaagcgggggccggagacggcgttggagttgtcgaggacgaggagggtccagtgggagccgccctcggcgtgggagacgtcggggttgtcgttgacggggaggaggacgaggcggcgggaggcgaggcggagggggtcggcgacggcggcgacggaggcggggtcggggaggttggagaggaggtaggggacggaggggggaagcaggagtaggtcgtcgtcgtggtggtcg

SEQ ID NO: 109645 - DNA, 930 bp, Oryza sativa
acggtactggccgtgcagcgcagggtgcatctgaaatcctgaacgaaactgccatcctagttactagtagatgctagtaaaacaattcgaaggaaaaaaggaacagagattttgtcatgaattgatattattaacaacagcacaccgaagtactcctcgaccttgtttttgattcaacaccaaacaacacccaattcagcataagctggctggcctggtaccatatagccatttacgtttggttcagcaaacccatcaacaaaataatctcatgtgcaccacaaaagctactagcaacgagtaacgtatcatgtacaaaatgacgcttttactatgccaaaaccaagaaaatatttccacatgacggcaaaaaaagaagaaagaagcaaatgctaaacggtttatatattctcgagtctgcttccaccacaagtatatataaacttgaaggacaacctcatggatgcatctttgatatatatatcctttcgcccaaaacagaacctgatgaccaaacgaggcaaatggtgagtaacttgccagcaaattccagaacaaacacagcaacaaattccagaataaaatggaagagaccaagcacaaacagtactaaccaatgcaataagaagataactcacaccacctatccaggacaaggggtagcaagccatgcatataatatagtaaaaaaagatgtgaatagaatggtgaaacacaaacctggtgcttgaaacgtctggttacacacccagtttcatgctggtccacttgaatccaatgcctttcaataaacactcatgcgccaatccacaagctcaacaatcaccaagttgagcctgtgcaaccaatcaatttcaagaactgagaaatgtgcaagttagctgggtgataggtcaagtcgcatctcccaaagatagggctgcaggaatt

SEQ ID NO: 109646 - DNA, 615 bp, Oryza sativa
attcctgcagcccgttgttggttacgactggcaaaggcaatcagtggaattatgttgtcattaacgataaatgcatgttttatcaggaaggaaaatctttattaagcactaattgggatatataataatgttatgaaatgtgttatataaagttgagttagatatttattaaaaagcttgtaatgttcggtgtatctaaagcttaatgtttgatttcaccgtgaagcgttttcaaactcctttgttttaggcaattttaaggtaatggaaatacacaagaatgccttttgactttgctttcaggaaattatataagccattagtttatatcttcatagatgctgtatcattgttaagctccatgcgattaattttatatgtagtgtccaatggtgatggtgtgatttgtacatatattcatttgaacaaaatgtttcacaacctgtaaaatatgccagcggctttgaagattacttttcttgacaaagagattcggtcaggtattgactagtcaatcataatcaaacttttggtttagtaatcttatcttaaccatatataaccatatttaacggtgaggaaatcatatttgtttgtattattatccgttaccat

SEQ ID NO: 109647 - DNA, 664 bp, Oryza sativa
aaaagcagtaaaaagaatagagattagaatcagaattccataatttcttggccatagattcgtctcccattacaaaaaacacacatacaaagcaatgaaatcacaaaatattatatcgaaccctcaagaagaaaagacgttttgttcgaatcaaaacattgtagaaagaagtcattaattccaaaactataggcgtaattcatcacaacgcctaaccacggagttcaccgcaggacaacccctaacacaactaatacatcatctttaccctatattctgatttgggggacacgtcaaaccaacccttagcagcatgctgaaggtttgataaatccattggtttgtcaaaagtcacaactaaacaatcagcaacaaattattgtcattatactcgacgattgctgggcaatcaccgggccaatagatgtccgggacaacacgtcggttggacggtcaacatcattagtcttttaaagagatgccttgcaaaaggtttaaacgaaacgttcagctttccaattctcgtcatacctctgtcgaagaatatgacacagaagcaatcacatctgaaaaaaaaggttcttgaaatgctccaatacaggcctatgatgagaaatgggttaaaatttgggatcaaattgagttgtcatatttatgtttgtgt

SEQ ID NO: 109648 - DNA, 965 bp, Oryza sativa
agcacaattggagacatggagtcgtcattgtttcttgttatttcttcaactttaacctaccaaaatagtgtcaaagcttatcaaaattctagcacaagttatggtaggacattgagctaaaccagccctaaatattattgccacaatgtgtcatgcatgtacaaagttatttcatccgaaattacaatatctattatattattaaaggaatagaaaaaagagcctccacgttcgctctcaaggcctagaaattctcacattaatcggagaaaaagaaaaaacagagtccatatagaaatacaatttagaaatagctaaaattcggaattaaaaataaggaatattagaagaggagactagagtccatatagaaatacaattaggaaataactgaaattcagaattaaaaacaaggaatattagaagtagggtatagagtccatatagaaatacaattagaaaataatagaaatttagaattaaaaataaggaatattagaagtagagtatagagtccatatagaaatacaattaagaaaaaaaatagaaattcggaattaaaaataaggaatattagaagtagagtatagagtccatataggaatttaaaactaactaaaactatattattaaagaaatagaaaaaagagtctccatgttcgctctcaaggcctagaaattctcacattaatcgaagaaaaagaaaaagcagagtccatatagaaatacaatttagaaatagctgaaattcggaattaaaaataaggaatattataagaggagactagagtccatgtagaaatacaattaggaaataactgaaattcagaattaaaaataaggaatattagaagtagggtatagagtccatatataaatacaattaggaaataactgaaatttggaattaaaaataagaaatattagaagtagggtatagagtccatatagaaatagggtgcagg

SEQ ID NO: 109649 - DNA, 677 bp, Oryza sativa
caaatcattaagcaacatccgtaagagtggcaaatagttaaaagccccgtgccagaaaggggagacgcgattggaaacggtgggtctcgtcggttgatgcgatcatctcaggccgctcggttcggtatccacgcgtttgcgcgatcggaccgatgagcgcagcgcgtcagcggcgaggcgagcacgcattttgacattcatttcaactgctgatcacactgtcatgatctcgtggaaacctgtctcgagtgcgattagctatgctctcctgtgctgacactctactatgcatgacagagtaatagtaataacgagctgaaagagacgggtgcatgtgtggggaaaagttttcagctagtggatcgatggatcagctcgaaccctatccatccacatcgaggtcccggaggccggagggctgtgaatgttggcaagattaactttttgctagccactactccatccatatgggcctcgaatcatcgacctcgatcgatcgaccgatcgatcattcactagcaagacgccaagctctcctctcgtttctactgccccctctccttcactgcatcttatccgctacagcttcacttccatgctgccttaccagttagggcatgtttggtacagctccaacccctaaatataacttcaggagttaagtttggagtggagtt

SEQ ID NO: 109650 - DNA, 2022 bp, Oryza sativa
agcatttcggtcttcggttagttcggttcggtctcggtcatgaccgaactcaccagaaaaaataatcgcaaaaaaattttgaagtacaagatcgataaaaatgcaactccgatgaaagggctaaaatatgatgatgccaccaagtagcaagtagagcatgatatggaaaaaaaggcaaatcaagcaaataaaacttggatcccatcgatgtcaaccactccagatcccatccatctctccctcgtcgctattcccgcgggccgcatctcccaagtcccaacagcctcctaccgccatcgaagctctcaggtcgccgaggggaggacagggaggtgagcaggagagggaaggtgaagcggtccggttgggggcggacggcgcggccacggaggaagcgagagccgagaagagcggaagcggggagcgactcgtgcgccgtgggggcatggggagttgtgggcgaactgatttttctttttccgatactcgatcgtggggactgggactgggactgggaggatgaggtcatgactggtggctgtggtagccggatggatggggagttggtttttgctatacgtgatgaggaattgggcctagtgggctgagatgtcatgtgttattgggccactgataaatttcggttttttcggtcaattcagttaaccgagtcatgaaaccgaattgaccgaaataaattcggttagttggaagcacagaccgaatttttcggtctcggttatttcggttcggtctttttctgcccacccctagacacaaggtccctaacacaaatgtcttgcactagacaggatgcaggggaaaataatcaccataagtcattgatgattgtggaacaactgagcattgagttcaatcaattcactgatactaaaggatgaggcatcaatcgacctagttagactgttgagggccttactggcatgcacacatctcacatcttcattactacttaatagctagttagctactatgaggtttaggattgaaagcaacatttaaaaaaatgaggctgatttaatgctcaaatcaaaatggctctcccgattgaacctatttatttatcagttttcatttgatatggccatgatttaatattaactcatggcttgtttggacataataccttcctatataattaagtaactgcaattaatttggagatatgcaatgacttcctcaacactaatatgtcactttaacaactcaaatatcatggcatgcaaatatgtaagccaaaacaaaagaagcaaaatgtcatattggtatgattgcaatgaaaaagatataaaggaataaacaaaagatacccatgatagcagcaagcacaaagcggttatccaaactccaaacaatcatattaacaccacgaggagtaggctggtatctttgacgtggaccaccgcgaggtggttgaggagccattggaggtggaggaactttaagatggtaagctcgtgtccaacgtccaacctttccctggatcaacaccaataacatgtcatgaaaaaaaatatttttgaatggaagtatagagaaagagcactaaagatgtctgcatttccacagtacagattagcaaccaataaacgtgccttacccagtatgtgtggtacaatattacagttggttgctaaggcaggtagattgtacactggccaacccttactaaacaacctctaacactagcaattcatcatgtgaaacaatgaaaatacacggtgatcgcataagaaaacaaaatgggcaattattcagcaagcgtttcatataccgtagcaatggacagaacaggcagttatgcaaatcacaatataactgttaatctaaaaacactttttcaggagcgaaatcaagagatctagatcacacgagcttacatgtgatctccgagatcgtggaacccagataattgcactgccatcacgggagcaggtgacaatattatgtgtgaacctagcaaaagcagaaaatttcagctgaagtgaaaccgttgaaacc

SEQ ID NO: 109651 - DNA, 5422 bp, Oryza sativa
gtcctcctcatgccgccgtttacagcctcaagaagcgtgcactgaggagcatcctggtggaggtgtacgccgccgccgctggcggagctcggacagcccgcctcgctcgcttgctccgccgcccacttgcccgtccgctttccaggaagaagggagagagaggaggagagggaagaagagaggagcaaggatgaggaagaagagagaagggagagggaaggagtgaagctgacatgtggagcccacgtgggccctatcattttaaaattatttttttaactgatatgtgggcccacggttttattatttttccgatgtagaattgccatgtaagcgccacgtccatgccacgtgggacgaagacctagtcaagccagccacgtaagcgccacgtcagccaaaactgtcttccaaatctccgagggaccttgacagtttaaggaccggttgtatctggttttgaggtttaaggacgaaaatcggattcggtgtaaatttaagggacctcagatgaacttattccttatggcctctttaatgtacaaattctgggcctttgtgaaagcccatgtaaggatgttactttgtctcgaaaatttccaatgacatagcccaagcatgaaactggccggcctaaaccagcaaaagtgtttgtgaaatgttctctctcctcaggcccgtttggtagagctccaaactccaacttcagtgggagatagctcctataggagctgaggtgggtgtgaaagtgtttggctagacttgttagctccacaccaccacgtctcttgtagtcatttcgtcgaacacttggctggcgtcgccccgccgtcagctgcgcaccgccactactgacgcccgccaccggtcagcccgcgcgccgccgccgccatcagtcccccctgcgccgccaccacccagcctacgctgctgccgcatgccacctgtgtcgccgtcgatgccgtcagcccacgcgtcgtcacccaggcggcacgccgccgccagcccccacgccgccagttgccgcggatctcgccggaaatgatgcgaggatgggaggaggagaagtttaggggtagttcggcatttctatgtaaatacatcaaaaaattaaagggtagtgggttttttgggtggagtggagctgtggagcagtaaaaacccagctccacccccgcagtacaaatttgtgaagtagctctgctaactctgctccaaaaaatagagaatctgtaccgtttaacacagctccagctctagataagcagctggagctgtgccaaacgggaccttaatttaaccaaaaatataaaaataattctcagtgtcttttgccaaatgcctctccagtgttgcagacaactcctccctccgtcccaaaatataagaagttttaggattggacacggttattaagaaagaggtagaagtgagtggtggagaattgtaattggatgagtagtggaggtaggtggaaaaagtgaatggtggagggttgtgattggttggaaagagaatgttggtggagaatttgttatattttaggacaaatcctgagggctaaaagttgttatattttgggacgggtagagtattacccatccacaaggctacagatactagtctactaggtttttaccgttgccaccatttgctcaatatatacacccaagaaggaacacaccaatctaaaaatttcacaaactctagctacaaacttggccatggatcactcctcaccttgctttgaactcttcaaactctccacctcataaccaagaagacaaaaataagcagtactttcagcgaccaccatcacaatttcccaaccatttttctcattctcaatacatcccacacttccacaatatttcattccatatggtgtttcccaagcttcaacacacaaaattatcaaccttatggagctcttcatcatcctttcccatatgaagccaatataagccattctccaactggagcttttggagcaagtcaagctggttgatcgtactcacctgtaaaagctaggattttttgtttataccaaacgcaccaaaaaaatcatagagaaaatttggtcttaataatattatattatacatgcatggcccacttctttcgttatatgggtttgttcggcagccaggctgcactgcacgctgctaattttgtgagtgaactattattcgtgttggttctactgtagcaaacacgaataatacttattgtaggcatgctttcttaagcttccaaatgatgatttttaatataaatttatatttatattttttttgtagaaaagacaacttttcaactttgtagctcttaatcaattcattttgcactattaaatattatctattcatatattcagaagaatcaaactgaagcaactgttgcatatgtttctttcccctgctaatatgcatgtaatattgtgctactctctgtctcggtccattctaacatatagcaaaatctagcactagaatagacataacctattttttccgtcccaaaatataatggattttaaatggatatattcagatttgtagtagtagaaaatgttgcatccatcaaaaatccattatattttagaacggatggagtaatattaggaatttgaacatggcatgtctctagattcatgatattaggttgtatcattccagtattacttctaatttgcttattttgtgatggatgaagtatctcttatttcattgttcttcttgaaaagatgagtcttatgtatatataatcaaatctcaaaaccttaagtcattaacaaacgcaaaatgtcagtattctaaatatggaaatcattttagtagattttcatattttttccatgtagctatattttaaatatttttacaaatatataatttgatgaaaaatactaataaaacatgtgcgatggagcccgtcagacgtcgaaaagaatctttttatgaacggaggtaataccaagcaagccaacgtgtttagatcaaccatatccaccatcgagctagttaatttagtagtacaacattgggatcgagacgacaagtgatagatcggggcaggcagtaatcagaattagaataggcactgatcactgatcagaattagaatactgacaggctccccgaaaaaaatagtaccgcaggtaattccgaaaattcaagttccagatctcgatgcctaagaggcttttaattgcccatgtgcattttttactcaaaatttgtgttggatttggtccttcttaatcttcccagtctagacacactttgatcgatcggttatttcgggcccagatataggcctctttgcaataaagaaaatttcaaggatttaatttctgtgggagttgaactgaatcatgtgaaaatatggtactccctccgtttcaggttataagacgttttgactttgttcaaagacaaattattttaagtttgactaagtttataaataaatatagtaatatttataatgctaaatttgtgtcatcaaatcaataattgaatatattttcataataaatttgttttgggttaaaaatgttactagttttttctatataaacttgttcaaacttaaaatattttgactttaaccaaagtcaaaacgtcttgtaacctgaaacggaggtagtataatttatgtatataaactttaaaaggagtgtattatgtacgcatacttttgcttccctgccacatgccattaggccatactctcttcgtttcatatcataagtcattttgattctttttaagtcaaacgtcttaaaagtttaatcaattttatagaaaaagataacaacactaataacattgcattagttctattatgtctaacattgaactttttttatatattttttattaaaaatattacttatattatttctataagcttagtccacctaaaaagtttgatacctacaaataaaattcgaaatgacttatgatatttatgatatgaaacagaggtagtacgtacagtattacagcacactgaccataccagacaagtcagcgtgttagtctaaccaagcaagtcaatggtcgagctagctaattttatggcagacgacaagtcgggcacgtgcagtcttgccgacaaattcggattagctacagtattacgcagtcatgttgttttgtaatatatgccgtttcggaaacgagcaacgttgtttttaattatgtcagagagactagtattcagcatcctgaggtgtccttttcgttctaaatatctccttttaatgccaagaaagcttttagtattggttaaggagagtgctcagatccataaaatattgattttgtttagtactagtgcattatgctgattaattttgcgttaccataataatatgatttttttataataaaagttgtctaatagtagtataatgcatatcatctttatatgtatgttcgagttgtctttattcttaatgtttgatactatcacaagaaaaacataataccatacatagtggtgcttgtgatcagtaaccaagtgcctttatttttggatggcatgatatctatcagatgacatgctagaacctatgtgattttcaaaacgttatttcaattgaaccttttctaaagggagttcgggtttatcccattatagtatatatgtattttgggtatcaaaacttaatgattatgtttatgaatgatgccagagatgtaaattatttttattataaaaaaaggttagcagccatgctatgatcggcacatcaagacacatgcaatacaaaaaatataaatgcaacaaaaatagtagcagttctatgcttagtaattactcccttcatctccaaatatgaggattcaaatatctaaatcctcataaagaaaatatgaggattcaaatatctaaaatcctcataaatataaagtatccttatcccttctttctctaaccaccgcccccaccttttatatgggaactacagtatttttccattgtccttaatttctcaaaaacaacccacaatcctttgggacggttggggcgtaatatatagtcagattaatatagagtacatatttttttagataatggaagctttattgatctcagtcatctaaggataatcccggcctctgcaccacgacagtgcatacagccaacaaactccgacacactcaaaataagagaaaaaaaaacagcatacaagatcaaggccctacaatccgaagactaggtcgccacccggtataatcaaaatgtatcaaatgaaaaactttgtaaagataatggaaatgtactctgttaattaggagtacacaataatgatacgacagaggatatagattaatgtaccaatgaatgtttttaattttttaacctttttaatcttaaaaataaaccattctaaaacttattttcaaat

SEQ ID NO: 109652 - DNA, 1451 bp, Oryza sativa
tttcaaggattagagattctgtttggtgtcaacagctagcaacgccaaatatacataaacaaattaaatggccagattcctgtacctgcagaattagattttaacagcagctagtgtactttcttgctacgcagaacttgctatttatacgtacacgaatgatgcagctagtagccaattattagccgagatatcaatcgatacttctaatgctggttgttatgacaggatctaattggtccacgtagcgtcttgatttcaaagataaattcgagttatcagagaaaaaaaaaccgattttgcaataaatctgttgacaaatttcttcctcagaatttgtcgatttttgaaccgcttgatgaacctcgggattcgtgcttttgcgtcgacgctttgatttgtctctttcgacggccgctggctaccggcactggcgcggctcatgcacgcgtagatgtcagacggagggcagagataaagcggcagggcatagccgaacatgcatgcatgaatgatggcctccacacgcatcgaacaaacagacattgcgagttcgtaatccctctttcacgtgagcagtgccaaacataagttttataacggtacatctcacttacgtgcaagtatattatagttacagtgtaattacatataagtaacaatgtaattattatagttacagtgtaattacatgtaagttatagtataattattctatacttacagtgtaattacaatataattatattgtatttacatttgacaaatttttaagagaaaatttatcgacaaatgtataggtagtaaaaaaaatacaaaactgcatccggaagcatctggcgtgcgtgatcagcagcatggacagctgggtctgttctctgtatgggcctgggtggacttgcagtgctaaatgggacgattggcctagcagatagcacaaatggggaatgaagatagattaaatttcaggtttaggcatatactggaaaattaacatcagaaatatttttcatctaaattatcggttataactttagctagatattttagaaaacaaaaaaaatatttatggatttcataaaaaaatacatctttattcctcatatatgtcgcctcaattgtcaatttatcaaacacatgcaatattcactttgttataaattaaacctacatgtcaattatcagacgatactcccactaaatggttctttcaaatatataatgtttgcaaaaagtaaatgggaaattaataagttattataagaaaatatataaaattcagtgctctttatacgggctaaaaagacagcgcgccaacagccgcactaatttttctagttatatattatataagtggagagaattttgacggcgttataacgtagccagcctagtgctctcatcgcccgttctgctagttggcgaatcaattcgattgtgggggctgcagg

SEQ ID NO: 109653 - DNA, 860 bp, Oryza sativa
taaagattttttgagctgtggtttttgtatatatagctgggtagtatatacgatcaatcgttccatgtcacttttgtgataaaaatctggttgagtggtggaatctgatgtccctgatgctgtaaagcttataataacagtgattaataagcagtctgccttttgttgtccgacgaagtggaaaaggtgatcagtttacttacaaaaaggaaagaagaaaagaaaagctacaccaatagctctaagaagccgcagttcatgaacatgctgattagtctccttaataatcattttgtagaagtttactccggctagactgttatcctattgaggtgcgtggctttgatcagtccaaatcattgacacgtgccaggcagaaactttgcattattgcatatattgggcagtcaaggagagtaatatccctcccatatcttatagaaggcgctcgaaacaagtgctagtttaataactttgctcgccaaagaaaacacggaaccgtcactgtttctggtcaaataagataaggctatcactttcatctgttgccaataactctttataatacccgtatctgttgagaatatgaggcgaaaagtactagtagtagctattcctattgcacatttgtactgaaacattttaagataaaaattctccacatttaactgggtactctatttagctcatactgttagtttatttttatttatttattttgctctggcttgttaaggtcgctgtgattgctccaaatgtcccggcactgtatgaagctcatttcggcgtccccatgtctggagcggtggtgaactgcgtaaacatcaggttaaacgccgagacaattgccttcctccttg

SEQ ID NO: 109654 - DNA, 1425 bp, Oryza sativa
tttttttttaacaaccagcactagacggtgcgataattcatttaatagagaaagaaaaaattacaagtctagcacattcgaaggcagtagctagaaaagaaaaaaactaccaccacacatctatacagaactcaggagaaggctagtattggattggccgccactaggcttaacagaaaaaagttacaactgaaaccatcaaaaacaaaccctaacagtgaacaccgcacttaactctcgccacacccttgggattggaagggagagggtgagagagaaggatggaactattttccccaacaaggcccaccaacatggccaacttgcattggctagagcgcgccgcaagaaaacaaacatctagagaaagcacacacaagttgtcggagaatgattttggcaggaaggtctcctagacgacgtcttcaggaagaaaagcgataatgaacactggcgccgtcgtctatcgaggtcttgaggagtaccaagatagagttttcacccagcagccccacctgagggagaaggacagctcgacagcgccaagagggaaaacgacgcccgaaacaacgtcgctgctagcccggcaaggccaagctaggtattacacctattgcccgcaccattacaacccgcagttaacgctccaatgctccaccaccggccaacctctgtcggcacatggtcgccgctgtaccgacgcttcttgttagttagcctcaccggcctccttgccattgtccttaccaaccacccggtgccacccacgccggccagctgctaccgccggtgccacccacgccgacaacccgctaccatcggcaccacccatgccggccttccgctgccaccgacaccacttgtgttgcgctagcctccctttgccacctaccgcgcactgggccgccttccttaacctagcacctaccttgccaccataaaactttggcctcccatgccagggtggcccgcatcgatgcgccgaatctggctttagatctggcggtgtccaccgcaaatgcggcctccgtggcaccgccgcttgctgcccccttcttccctatctccacctccgcctagctctagatttggtggcgtctgtcacaaatccggtgatgcccaccacgtccgtggcctccccgctaccactgccacctttgctccccactgtttgttgtctcctccgtccccgcgcatgccgctgctatccacgtaccagatatggggttgtgtcgtctcctgcgccgcctccatctgcgcgccgtattgagtgtggccgtcgccgcgggccccgtcactaccgtcctagcaagccgttggctttgcctgccactcgctcaggcggtggctaggtagagggggaggggaagaagggtggcaacggttggtgtgtctttttttttcagagtatttttttttggatct

SEQ ID NO: 109655 - DNA, 1180 bp, Oryza sativa
aactgttttcgactggggcggacggaggacttgggtggtatccggaaaaggctagtaccgtccccggtcaattaaggaccgagccatgaagttaagcatgaaacgacccccgtacaaccgcacttctcatataggtatagacctagcggaatagatagctgagcggaggcagtatccatgcatagtggtttcttgatgtgtgaggcaggggctctacggtggggcagccattggtagaaccgcgaggcgggtgtctacagtggtgtcgccatcggtaggactgccatgagaaaaattaaacataattataacttaatgcatgtgtgagtctttccttcccgggtgcgccagaactcttctcactgctagaaaccgtgtacgcctagagtgcatgaggatgtaaagttcatggagcgggtactgccaatgcgaggttatcggaaagctttgccgtgacacgtctcatgtgttgagacgaggctcatgtgttgggcagtcgcggagtgcgggtaaagtatacatccactgcagagtgagtaaaccaaatctattcgaatagccgtgctcgcggttattgagcaccgggacatgtattacacttggctagactctaaattcttaacttgtgtgggatgggatattgcatgataatttctatactgatggagccacttcctgagaggcgggaatgtggacgtcctcagaaaaccatgacgactcaatggcaggaagctatccttaggatcacaatggatggtggacagaaccgtcattgtttaatatgaacactggtactaaaatttgatcagtctgtgctaggtcttagggttgtgaaaagaattataaaacttgctttgcgcaaaagaaccatagccatcctttaaatacccctgtcatgtgcattgttgctgtggtggcttgctgagtacggttggtactcacccttgcaaatataaacttaatcagaggccggagatgaaacttccgaggatccctatgcctattaccaggagggtgatgaagacgatggcgctcagtaggtcttagttacggtcgctgcctgtggcaatggcgtgccgctgccttaactccgctgccttacctacttctgtttttggaatgtattccggacagctcggtccgatgatttaagactatgcctgcgggcttatgatgtaat

SEQ ID NO: 109656 - DNA, 702 bp, Oryza sativa
aaagtttaggccctccttcccaacaccatcttaggatgagtgaagaggtagagacaaataatatattttattctctatggacagcccatatgtttatgggtagcttttgttatttctttgttatgaactagttccacaatattgttaggtggctgaaacaaatattgtattgcttatggaccacttttaaactatattgtagatgcccttattactatagtctatattattctcacattgttcaattataaactttattattaagcttgggtggaaaattacaagtaaatttctcgtcaaccgaaataaggtttaacagttttcctcgcaaccaaaaaactataattatttactatattattctcacattttccgaagattgaagaatttaactttcccttctgaggctgaccgatccatattttgaacatgctatttttgttgttgctattgagcaatatactacaggtgaccggcactgtgaacaagaaaaccatgttggttactgttctgcctcttggatactgcaaaatttactttgatcttccgttgccagtgtcatatgtacaagaactaaacctgcttgacatcaataggggaggacgtctttctgcactaaccaagtacatcaagaactgatgaagaacaggggtatagtactacagtatccgtaagtttctacatcatttttttctcatcaag

SEQ ID NO: 109657 - DNA, 1943 bp, Oryza sativa
aattctcaaggacggactccaaacaagttaattcttccggcacatgcatgcgtgttgttttaaaaaaaaaaaatagaacgcggcgatcaaacatgcatgtggcgccaccagactttctcctctgcgagaccagtcttaaaacatgttctgtttgaatcagcaaagcctcatgaaccaagatccaactgattactcaaagaaaccaagcagtttgcgtcactcaaaagaagagcatgcaagagcactcaccttctcagttcaaggacaaagccatgacctgcccccttgcttgctcgtcgttgccacaccgcgcgcgccgcagcgaaggccagcggctggcttctctcccggcaatcgcacgtacggttaattagctcgcaacgctcgctaacgagccatggcactctatattcttgtgtccatttggatggttggtacgaggagtagagagtgtgcaatctgggcggctgctgtctgttgctgttggtcgcctttacttctagcagcctagcctagccctgggcacagctgccattgatcgtcaacgctacagagcggaggtgcctttcgcgaggcgacgtggtggtcggctcggagtccgattgatcgaaatcgaagcagagaagtgaagagcgtgtactgtacggctgtgtttttccttttaaagttaaaagtttgggttgaaattggtacgatgtgactgaaaagttgtgtgtatgataaattgatgtgatagaaaaagttgaaagtttggatctaaacacagcctacgtagtacgtactccctccgtcctataaaaacacaacctagtactggatataacacatgctagtactactatacctctgtccaaattcattgttttagaatatgtcatattcaatactactctctccgtttcacaatgtaagtcattctaacattttttacattcatattgacatcaatataaatgtgggaaatgttagaaaatatatatctagattcattaatattaatatgaatatgaaaaatgttagaatgacttacattgtgaaacggaggaagtatatttgttttttttaactgatggaggactactctccgtaggtagcaagcaaaacggttgggctgttgctgccactgccaaccgggacagacaagtcccgcggccgcgaatgtggggggaggccgctgctgttgccgggggggcctcgcagctcgttcgccgcgcgcgatattctcacctccgtgcgccacgctcgatcgatcgatcgctttcgcgagatgctgatctgtcgacttgcgcgctggtacgtacgtgccggtagggagtacgtggggcacgaatgctgcggcctatctgctgaatcgtaattgccgttttgaagtcttggataggaaccaggaaaggaacgcgcctaagctacgtgagtgttgggtagtacgtagagagaggatggaggatggggatggatgtgcccccgcagctaagaaccttcccccattgtcttgcgataaatttccgtaaattaataaattttcgttatgccacaagatttgcatcaaaatgccattgtttttctatctctcaatacatcgtgtaggcccaagtcgatccttaattagggaatgctgcaatagtcaaacacttgtccaacaccgttaatcattggaccagattacgtacactcgtgggtgcattttctttccctacttgtatccactggcgagtggtgtgattgctctagatatggtgaactatcgatgagtttgagagtggttcactgtgcccttcatctgacatctgcgcttttacgcttttctgtataaaaatccacatttatttctacgatcttacggagtaccgaaaagaattacaaaaaatctcttctgagtaagtctcttggatgtctctctcaaacagacctggtttagttcctaaattttttttcccaaaaaa

SEQ ID NO: 109658 - DNA, 3508 bp, Oryza sativa
tttagctgggaggtgctgtcttgtaatacaagtttagatttgttactatgggctggtttggttttgggtctaaattggccttaccaatttttatcaatgtcaaattttgtcaacttttggcatggctaattttggcaaaggtaaaattgtgtttggattgaaaccaaaatagcctaaattaactgttgaaatggcctattttcttaggcatgccaaaatttggctccaaaccaaatagacaataaacactattgaaattgacaaatattggtaaggccaatttaggcctcaaaccaagccagctctatattaggagagattatattagaagaggtcgcatacccatctagattgaggtcgtgtttagttcaccctcaactaccccaaactttcaactttacatcacatccaaaactttcttacacacataaactttcaacttttttttttccaaacgttcaactttccccaaactttcaacttttttcaggaactaaacaaagcctgagtaattttgggatggagggagtatgtctgaaaataactttattcttattttcctttttaccactggtttgtatttttctattactttagtgctctttaccaatcccttgcctcttacctattcaccattaatcctatcattttattaatatatgcttgcttcgttcataaagaactaagtataatatgtgacgcatcctattaattaagaaagggagactaccttatcgaggacggtattgtttctcggagtaaaagaaagctagtctcggggaaggtatggttgcttggagtaaaagaaatatagtagcaaaggatagttggttttgtgcgaagaaatagtgttttctattttcaagtgagagaaggactaccttaccttggatatgttaggatttctcttagggtgtgtttagttcacgttaaaattagaaatttaattgaaattggaacgatgtgacggaaaagttggaagtttatgtgtgtacgaaagttttcatgtaatagaaaagttggaagtttgaagaaaaaattgggaactaaaccaggcctgagtaaaaaaaaaaaagcacggtgctacgaggagtggccttgtttagttcccaaaaactttttcccaaaaatatcacatcgaatatttggacacatgcatagagtattaaatatagataaaatgaaaaactgattgtatagtttatatggaaatcgcgagacgaatcttttgaacctaattagtccatgattagccacaagtgctacggtaacccacatgtgctaatgatggattaattaggcttaataaattcgtctcgcagtttctagacgagttatgaaattagttttttcattcgtgtccggaaaccctttccgatatccggtcaaacgttcgatgtgacactcaaaaattttcttttcgcgaactaaacaaggccttagagtcacacccaaaatcgaaatgaagctattttgggatagagggagtaaataaactccatagatgttgcctcttatttcggggtattttggtttagggtagtgctaaaacttttggtagttttccggacgtgtttatagagaatgagcgtgtgcttataaaggtgagtgagagcatgtgtgtgtatgactatttgtacttatactatgttttgaaaagaaaaacagtggtgttaaatcttaaataagtttttgcattatcaatatttttggtatggtggagtagctttactcgaattgattgacaacttttgatatcatgcttgtttactttattgccaacaaagtaaaactgatcatttgtgagtaagacgtaagccaaagattggtaatgctattgttaaggacgtatctacaacgagaccgttctctatatagtcataaccaactaactcaatctcatatctaattgctactagtatactcaaaagtgcatgtatttttttttcttatgaaattttctcttagattagtcatccgatttacgatccaattacaccattatgttcataacaattaaatctttataacaagatctcacatgactatatttttatgaaaaaatacaaattacttttataatatatgtaaattacttttagattacattaaattacttcttagtcataaaagtaatttacctatatatagaagtaacttaaaaaaagtaaagtaacttgttacgacattaaaagaaatatatacattcataatgttattcataatattgtgagttgtttgttttacaatcatttttagtcagtgacgtaatttgtgccggttaaatttaatttctatatagactcatgtttttacctccataacggatttaattttgatgtcgtgataaagttactttctttctgttttaagttacttttataatttatgtaaattacttttagactttactaaatttactataatatgtctaagtagtaatttaatgaaatccaaaagtaatttagatatattataaaagtaatttataatttttcatcaaaatataatcatgtgagatcttgttataaagatttaattattacgaacacaatcacgtaatcggatcatagatcggataagttatttaagagaaaatttaatttgaagtataagtggttcctatttgcttgaaacataggggataaactactctctctctctctagcgtagtagagtgcgtcacatgctttccgatttggtctgttctggccttcttggcaatatcggcatgtggaacagatcagacgactacaccagcgtgtgggatcggacggtcctagatgcgtcgcgtgataagaccagatcgagaggcctctcgacttagattttatgtattgttaagttccgacaaggttaaaaaagtaaattaaaggtggtgttgagtcttatatcttattaaattttggtgtagtttcgagagtaaaaagggtatggaattaccaaattttgattgaggttataacgttgcaatagtaaaatctcttgggtgtgttctcaacttcttctctctcgttttcacacatagcttcctaaactgctaaatgacgtgttttatttaaaaaaatatattaattcatttttatatacaagagagaagttcgtaactttgtatcccgaacacaattagacaatggagcgaacaagcacatcaatccaaaatgtagaccattctattaatgctattatattttaggaatgttggattcaaaccaaatagccttcaccgttgacccagtcgggaacccaatagcacacaaccaccatcaacgtatatacggtatattcgacccgtcatcatgataaaagagatcattagtctggcatttacgtaagtattttttattagaggaagtaacatacattggtggagaaaccatctttggtcggtcaaccaaaattcataatagtcccggttccactaaaaactgaaactaaagatgatctttagtcccggttccactaaaaaccgggactaaagatcgtatgttgtcaggggctgtcaggc

SEQ ID NO: 109659 - DNA, 756 bp, Oryza sativa
tccctcccccccttctccacacgccgccgttgtcgtgccgccgcgccgtgccgcgacttgcgccgccgccgctgacggtgagccgccgcctttccaccccccccccctgcgtccaccaccgtcgccgccgagagggcaaaaagccgagagagagggagggagaacgaagctgggagggagagagagagaaaagaagagaggaagagagaaaggagccgggagagagaaaagagaaaagaagaaagaaagaaaaaggagagaaaggaagaaaagaaaaaaaaagaaaagaaaagaagagagaaaagaaaagaaaagaagatatatataaaaaaatataagattagggagaggttaaggaggtttagaaaatttaaaataattagaatttaattatagattaattatagtcgtagaattgtaaaatttaatataaattatagattattcttggtaatttctataagaaatcaattcgcggtagtaatttagatgtaattaataactaaacaattagatgaattcttatagattattatagattatttttgggtaatctctataagtaatcgattcacggtagaaattcggatttaattactagggattttagacgtatattatatttaatcgtttagtcatagactaaattaaatcgtacaatattataagataattttaggattttgtccgatatttagcccgcgatggaaatttctaacctattaaatggatgtaatactcgggctaattaaatta

SEQ ID NO: 109660 - DNA, 667 bp, Oryza sativa
ttggtgcttcctatatacttctagctagcagctgcaccaatacacacatgcatatcttagctgccaaggactagcaagcattggcgtgcgtaggacccaaagttagatgcaggcggagtttattgactactataccagttggaagttgattgagatttggtaaacagcattaggaccaactagaattaacctctccacttttaactcgacatcttcagaagcatggcgattgaagcaagaaaccaaagatgggagggaggtgggggcaaagagagagagagagagagagagagagagagagagagagagagagaaaagaagaagaaaatgtcctctagaatattgcttgagaccgaaagattcaaaagggagagctggctagaaagaatcaaatgctgccatctttgttcccaaggtgcttgtcacttgacatgcaccgttgcatctaccttccttgcaaacaacccctccccccatgtcaattttcgcaccccggatttaattcctcagccttttaaaaaaatttccatccatcgatctgcacgtgatggcgattgattctgcacactatagcagcaagtttacctgtagatgtgtaaagccatctggagaaggatgcataaactaatcatcaacggcgacaaaagtatacaattcgctggtggca

SEQ ID NO: 109661 - DNA, 836 bp, Oryza sativa
aggacctgctcgccgtcgcacgcgtgccgccggccgtcgaccaggtgaagtgccacccggtgtgcaagcagaccaagctccgcaagttctgcacctccaaaggaatccacctctcagtatgttgctcagcactgcaaactaccgctccctttattctcagatactccctccgggattttggttgaataggatatcctatatacgtgtattatcaaacaaaaatctcttatattttgcgatggaggaagtaattaacattggcattatttaagcataaactttgaacctttttttacagaaagttttataaacatatgaaaatacactatattattgaagtatataagttataaatataaccatacaatttcatcacaatataatcatttgaaagcaatatgtggtcaatgtgagataacctcagtttactgtgtcagttattcatgaatgagtacatttataggggagtggattctaattcctcgatgggatgtcccctcgtatatttttttttcaaattcgatacaaatagtcgtaaaaaatatgaaaaaaaataactatgttgagtattgtgatatctatctgtcaaaaaaaattaaattcgacttacacatcgagaaataaaaaagacaaattcagatgtgaacagtacactactattcatatgctgaatttatctttttatatctcgatgtgagtttggacctaagattttatggagttgtatagataggagtacatccattttttaataaaatgacacagttaacttttttataagcatttgatcatttgtcttattcgaatttttaatgcgaatataaaaaataagtcat

SEQ ID NO: 109662 - DNA, 631 bp, Oryza sativa
cgccgtgtagggcgggcggccctggctgttgtagctgatgtagttccagtacaggcggccgagttcatggtccgggtccacccgcagcaggtcgctcaggtccgcgtacacgcgcgcgtacaggcgctggcgcttggacgtggtgtgctcttccaccaggaagccccagttgtcgcggacttggttgaagcggtcggccacgtgctccttcagcgcgtcggcacgcggcttgaacaccagccggacctgcgcaccgtcgagggcatcggcatcgaagcctggtgcggccgaggcgatgctcagccacaggctgtccggggtgaggatgcgatcgcgcaggtccagccacagcgtgcgcgcctgccgtggcggcaccgacaccgatacatcgatcatgtcgcgcgccggccagatcggatccttgatgcggatgttcagcgggatcagtccatcgtgggtgggcggcaggtccagcgcgggaaggtcgatggccacgccgtccaggccgtcgtgcatgttctcccagctgtaggcccagctgcggatcagcggctggttggccggcgcgtcacccaccccggaaggaatcagcacgtgcacgatcggctgcggatgtgcgggcagggtgccg

SEQ ID NO: 109663 - DNA, 712 bp, Oryza sativa
aaagtttagaaattcaaagtaaaaggtaagtaaataaagtaaaccaaacttgcaagataagttgaaacagttggaaacaaggttacaaattttgtacttttgaacatcaggtttcaaaagaaataaaagaaagttataaaatcaacttgctaaatttattttattgcagcaagattaaataaaacaacattgtaaaacttttgctggaaaatgagccattagtacagtaatagatgtatagtactaataacactggaataaattttgaatgagaaccattaaaagagattatgaagtgcatgtgccattagtttggtttaattaaaaaagaaagggaggagaacagttctacttttccaacatttttagagggcttctatggataaccatttggcataacctaggttcaagggagctctgataccaacttgtcacgcccggaatttctatccaaaattccaaacgcttacatgtgtgtgaaccctcgtccaggaatcagccgaggcacacaataacaaattgataatagagtacaattattactctaattaataagcgtataaaatgtcattacagaggtagatagttcctctcaatcaataaagatctaagcagcggaaaataagataaacggcgcagacggctccactccacaggcagcttgaccaaggctacacctaatcctccacaccatcagcttcactgtagaact

SEQ ID NO: 109664 - DNA, 707 bp, Oryza sativa
catcttaacaagcacataggttgaagaataaacactaaacacatatacttattgcatttatcactctttctcaaataaccttgagcacaaaataaccaagaagttttttttaactttttcttttcttgagcctttttgctcatatttttctcttttattccgggtacgtccctgtcgtcaagactgtttccagggattcggcacccattattttgctcacatcgaatacgtccttgtcgtcaagactgtttccaaggattcggtattcattttttatattttttattccttctttcacaatgagcaattaaagctatttgaggaataacaaatcaataaagcatatatatagagcatttataaatcaaaccatatgctagcatcaacattgcatattttcttaattcaagtatagaatttaagtgtcatgcatcatctcccttaaaagcaaaatctaaatctcatgaaaagactagaatacatactgtcacgcccggaatttctatccaaaattccaaacgcttacatgtgtgtgaaccctcgtccaggaatcagctgaggcacacaataacaaattgataatagagtacaattattactctacttaataagcgaataaaatatcattacagaggtagatagttcctctcaataaataaagatctaagcagcggaaaaaaaaaaaagcgcagacggggtgcaggaat

SEQ ID NO: 109665 - DNA, 921 bp, Oryza sativa
acaccaaacaagtactcaggcttgaagcgcggcatctaaagacaaatgaaaggagggggttaagacatttatccaattaatagcacaagtttttggattaatttgaataaagtttagaaattcaaagtaaaaggtaagtaaataaagtaaaccaaacttgcaagataagttgaaacagttggaaacaaggttacaaattttgtacttttgaacatcaggtttcaaaagaaataaaagaaagttataaaatcaacttgctaaatttattttattgcagcaagattaaataaaacaacattgtaaaacttttgctggaaaatgagccattagtacagtaatagatgtatagtactaataacactggaataaattttgaatgagaacccttaaaaaagattatgaagtgcatgtgccattagtttggtttaattaaaaaagaaagggaggagaacagttctatttttccaacatttttagagggcttctatgggtaaccatatggcataacctagggtcaaggagctctgataccaacttgtcacgcccggaatttctatccaaaattccaaacgcttacatgtgtgtgaaccctcgtccaggaatcagccgaggcacacaataacaaattgataatagagtacaattattactctaattaataagcgtataaaatgtcattacagaggtagatagttcctctcaatcaataaagatctaagcagcggaaagaaaagataaacggagcagacgacttcactacacaggcagcttgaccagggctacacctaatcctccacaccatcagcatcattgtagaactcttcctctgatgaatgattgcaaggtgagtatatgacatactcagcaagccacgcaacaaatatgcaagtgcacaggataacaaaggatggcatagtaggg

SEQ ID NO: 109666 - DNA, 751 bp, Oryza sativa
tttatgctaagagttgaattctcataaaaatgtgatcctcgaatttttaatagacaacacctttgacttgaaacatatgtttgactaaccatcttatttagaaaatcttgtacaaatatgcttaaggtacaattaatgataaaccaagtaacaacaaaataaattataattatatatttttgaaaattaaatgaatggtcaaacgtatgtataaaagtcaattgcaccattaaaaatcggggagagtatagtataaccacataactttcattcattataaccttactatttaaaaactatgggtgtatttagttctttaggtgtaaagtttttaagtatacgggcgcacatttgaaatattaaacgtagactaataacaaaacatattacatattctgcatgtaaactgcgagacaaattgattaagcctaattaatccgtaattagcaaatgtttactgtagcatcatattgtcaaatcatggcgtaattagactcaaaagattcgtctcacaacttacatgcaaattgtgcaattggtttgttttccccacatttaataccctatgcatgtgtccaaatatttgatgtgacgtttttggtcaaaattttttgggatctaaacaaggcttatataaaaattgaaacggtgatggtggccaatgctgataaatgtttttttttggtaaaagatcatttcgccatggtagcgcattccactgggttccttattccgattgcgtgccttgcct

SEQ ID NO: 109667 - DNA, 552 bp, Oryza sativa
ctggttaaataggcttgcgattttgtgaacagtccaacggagcagatggagaatcaatgaggcatccttgagagaggcatatggttttggctgtattagtttctccttaatgaagtaataaaacaagcataattaaatcgcgtgcaaccaattagtacatcgtgacaaattttttgttttcttcgggagggtagctgtcagatgctaatggtggttgtcctgacgtgttacgtgtatgcaccagatgaccagaaaccccatcgttgcatgagttcatcgccgtcagatggtgaaatgagtgcctgtgtcttcgttggcactcgtaaaatattgagccaacgacttcagagaatagaacggcgatggcccaccatcccacgaaaggtaccaaaaggtgctggactgcaaattcgaaattaacaattttcttaaacaaatgcataacgtagtacgatatttcgtattgagagagcataaaaattataaatgtacagttctaagagaatatagcgaaaaaaaaaacaccccataacagtggctaggggtggacgt

SEQ ID NO: 109668 - DNA, 610 bp, Oryza sativa
aggaagtgggcgtgaagaaattcaagaacttccctaaccgaagtatgccctcacccattaccaatctcctgttcatcagaagggcctattcttcacaaggtagtagcaactagcagttgattgctagacattctttatttcgcgcaattatacctgaagctaaatttaaatagattaaatatacatccctcacttctacatccaaaagaaaaatatatatgtatacatgtttttattgcatgaaagatacacatatactatgaatgcgcatccttaagtacgtatagtacatatttatttcactaaatttctactaaaatcttacccacatgtttatagacactggtatttaaatcctagtgtacggacccatacacacatgatccaccacaatacctctcgggcctccccatttgcgagtatattttgtataaaactatatttaccaattcacacagttattataatttgacccaactcgattaagtgatatttgtagttctctttttctaaggataacatgatacctttttatatgtctggagcgaacttgttggattttcttcatatatactctcttataataaagaccagagaactttatccataa

SEQ ID NO: 109669 - DNA, 597 bp, Oryza sativa
gcccggtacggtgtgcatgcacgaacacttttacttcttcgagtgatcatttgagttttatcttatgccaaatatcattaagttcgaccatattataaaatgcccctataaaaatatacagtaacatccatcattcaatatatttttatagtatatttatttttaacataaaatgttaaaaatattatattttttaaaaaataattaaacttaaaaatatgacataggaaaacttataatataaaacggagagaaagagagtactatttaaatatttaaacattgatggaccttttacccttgctagatctttacatcagaactcttcagtgcctacctgacacaaacaatagtgtaataaaaccattttacatttttgcgagggtaataaaacctttttatggctctactatatggcatatgtacctccattgcatattgctatgaaaaaatagaatggtttctaagacatatgttcttgaatgtattctaagacatattctctcttttcttgtaaaaaaattataggcctaataatttgtaaaagttcaatggaacattatgcatttcaaataagggacaattactaatttgact

SEQ ID NO: 109670 - DNA, 10 bp, Oryza
rtacgtggcr

SEQ ID NO: 109671 - DNA, 11 bp, Artificial
  Synthetic sequence
ggacgcgtggc

SEQ ID NO: 109672 - DNA, 19 bp, Rice
gcatctttactttagcatc

SEQ ID NO: 109673 - DNA, 11 bp, Oryza
gtacgtggcgc

SEQ ID NO: 109674 - DNA, 10 bp, Arabidopsis
ryacgtggyr

SEQ ID NO: 109675 - DNA, 8 bp, Oryza
acgtsssc

SEQ ID NO: 109676 - DNA, 8 bp, Oryza
ccacgtgg

SEQ ID NO: 109677 - DNA, 11 bp, Triticum
ggacacgtggc

SEQ ID NO: 109678 - DNA, 6 bp, Oryza
tacgta

SEQ ID NO: 109679 - DNA, 7 bp, Oryza
taacara

SEQ ID NO: 109680 - DNA, 7 bp, Oryza
tatccat

SEQ ID NO: 109681 - DNA, 9 bp, Arabidopsis
taccgacat

SEQ ID NO: 109682 - DNA, 11 bp, Nicotiana
taagagccgcc

SEQ ID NO: 109683 - DNA, 14 bp, Oryza
  misc_feature (9)..(9): n is a, c, g, or t
rtaacarantcygg

SEQ ID NO: 109684 - DNA, 11 bp, Oryza
ctacgtggcca

SEQ ID NO: 109685 - DNA, 12 bp, Oryza
aacaaactctat

SEQ ID NO: 109686 - DNA, 18 bp, Oryza
atatcatgagtcacttca

SEQ ID NO: 109687 - DNA, 18 bp, Oryza
atatcatgagtcacttca

SEQ ID NO: 109688 - DNA, 19 bp, Oryza
tatctagtgagtcacttca

SEQ ID NO: 109689 - DNA, 19 bp, Oryza
tatctagtgagtcacttca

SEQ ID NO: 109690 - DNA, 11 bp, Oryza
tccgtgtacca

SEQ ID NO: 109691 - DNA, 11 bp, Oryza
tccgtgtacca

SEQ ID NO: 109692 - DNA, 15 bp, Oryza
cttttgtgtacctta

SEQ ID NO: 109693 - DNA, 15 bp, Oryza
cttttgtgtacctta

SEQ ID NO: 109694 - DNA, 14 bp, Oryza
aagcaacacacaac

SEQ ID NO: 109695 - DNA, 19 bp, Oryza
atgctcaatagatataagt

SEQ ID NO: 109696 - DNA, 11 bp, Oryza
ctttcgtgtac

SEQ ID NO: 109697 - DNA, 10 bp, Oryza
agcggtaatt

SEQ ID NO: 109698 - DNA, 7 bp, Hordeum
taacaaa

SEQ ID NO: 109699 - DNA, 15 bp, Zea
cacatgtgtaaaggt

SEQ ID NO: 109700 - DNA, 9 bp, Oryza
cagaagata

SEQ ID NO: 109701 - DNA, 11 bp, Oryza
gatcatcgatc

SEQ ID NO: 109702 - DNA, 15 bp, Oryza
ccagtgtgcccctgg

SEQ ID NO: 109703 - DNA, 13 bp, Zea
tccatgcatgcac

SEQ ID NO: 109704 - DNA, 13 bp, Zea
tccatgcatgcac

SEQ ID NO: 109705 - DNA, 7 bp, Glycine
catgcat

SEQ ID NO: 109706 - DNA, 7 bp, Glycine
catgcat

SEQ ID NO: 109707 - DNA, 7 bp, Glycine
catgcay

SEQ ID NO: 109708 - DNA, 7 bp, Glycine
catgcay

SEQ ID NO: 109709 - DNA, 8 bp, Vicia
catgcatg

SEQ ID NO: 109710 - DNA, 8 bp, Vicia
catgcatg

SEQ ID NO: 109711 - DNA, 9 bp, Oryza
tgggcccgt

SEQ ID NO: 109712 - DNA, 9 bp, Oryza
tggtcccac

SEQ ID NO: 109713 - DNA, 8 bp, Oryza
ccaggtgg

SEQ ID NO: 109714 - DNA, 14 bp, Oryza
caacaaactatatc

SEQ ID NO: 109715 - DNA, 7 bp, Oryza
gtacgtg

SEQ ID NO: 109716 - DNA, 6 bp, Oryza
grwaaw

SEQ ID NO: 109717 - DNA, 6 bp, Oryza
cctttt

SEQ ID NO: 109718 - DNA, 8 bp, Oryza
tacgtgtc

SEQ ID NO: 109719 - DNA, 10 bp, Oryza
gccgcgtggc

SEQ ID NO: 109720 - DNA, 10 bp, Oryza
agtacgtggc

SEQ ID NO: 109721 - DNA, 10 bp, Oryza
aacgcgtgtc

SEQ ID NO: 109722 - DNA, 7 bp, Oryza
aattaaa

SEQ ID NO: 109723 - DNA, 13 bp, Oryza
tatccatccatcc

SEQ ID NO: 109724 - DNA, 13 bp, Oryza
aataacaaactcc

SEQ ID NO: 109725 - DNA, 12 bp, Oryza
taacaaactcca

SEQ ID NO: 109726 - DNA, 11 bp, Oryza
gacacgtacgt

SEQ ID NO: 109727 - DNA, 15 bp, Oryza
acgtacgtgtcgcgc

SEQ ID NO: 109728 - DNA, 8 bp, Oryza
cgcgccgg

SEQ ID NO: 109729 - DNA, 8 bp, Oryza
cgaccagg

SEQ ID NO: 109730 - DNA, 8 bp, Oryza
atacaaat

SEQ ID NO: 109731 - DNA, 10 bp, Oryza
gacgcgtgtc

SEQ ID NO: 109732 - DNA, 12 bp, Oryza
ctcctgattgga

SEQ ID NO: 109733 - DNA, 7 bp, Oryza
tgwgtca

SEQ ID NO: 109734 - DNA, 7 bp, Oryza
caagcca

SEQ ID NO: 109735 - DNA, 11 bp, Oryza
gccttttgagt

SEQ ID NO: 109736 - DNA, 7 bp, Oryza
ccttttg

SEQ ID NO: 109737 - DNA, 8 bp, Oryza
tgcaaagt

SEQ ID NO: 109738 - DNA, 5 bp, Oryza
gtcat

SEQ ID NO: 109739 - DNA, 7 bp, Oryza
tatccca

SEQ ID NO: 109740 - DNA, 14 bp, Oryza
gacaccaagtggca

SEQ ID NO: 109741 - DNA, 18 bp, Oryza
aaccaatctcatccatcc

SEQ ID NO: 109742 - DNA, 15 bp, Artificial
  Synthetic sequence
ccagtgtggcgctgg

SEQ ID NO: 109743 - DNA, 13 bp, Arabidopsis
cttccacgtggca

SEQ ID NO: 109744 - DNA, 18 bp, Oryza
tggatgtggaagacagca

SEQ ID NO: 109745 - DNA, 17 bp, Oryza
gcccaacccaacccaac

SEQ ID NO: 109746 - DNA, 10 bp, Oryza
gccacgtaag

SEQ ID NO: 109747 - DNA, 10 bp, Oryza
gccacgtcag

SEQ ID NO: 109748 - DNA, 7 bp, Oryza
tacgtgt

SEQ ID NO: 109749 - DNA, 7 bp, Oryza
gacgtgt

SEQ ID NO: 109750 - DNA, 12 bp, Oryza
aagtcataactg

SEQ ID NO: 109751 - DNA, 12 bp, Oryza
ccatgtcatatt

SEQ ID NO: 109752 - DNA, 14 bp, Oryza
aatgatgtgtcaat

SEQ ID NO: 109753 - DNA, 13 bp, Oryza
ttccgtgtaccac

SEQ ID NO: 109754 - DNA, 7 bp, Oryza
tgagtca

SEQ ID NO: 109755 - DNA, 13 bp, Oryza
cctttcgtgtacc

SEQ ID NO: 109756 - DNA, 9 bp, Oryza
ctgagtcat

SEQ ID NO: 109757 - DNA, 8 bp, Oryza
cacgtcac

SEQ ID NO: 109758 - DNA, 23 bp, Oryza
  misc_feature (9)..(12): n is a, c, g, or t
tacgtggcnnnnccgccgcgcct

SEQ ID NO: 109759 - DNA, 8 bp, Oryza
gtacgtgg

SEQ ID NO: 109760 - DNA, 10 bp, Nicotiana
gcaacgtggc

SEQ ID NO: 109761 - DNA, 11 bp, Oryza
ggtacgtggcg

SEQ ID NO: 109762 - DNA, 8 bp, Triticum
ccacgtca

SEQ ID NO: 109763 - DNA, 13 bp, Oryza
aacaaactctatc

SEQ ID NO: 109764 - DNA, 9 bp, Oryza
gtgagtcac

SEQ ID NO: 109765 - DNA, 6 bp, Oryza
tacgta

SEQ ID NO: 109766 - DNA, 7 bp, Oryza
tatccay

SEQ ID NO: 109767 - DNA, 7 bp, Oryza
tatccat

SEQ ID NO: 109768 - DNA, 11 bp, Oryza
ctacgtggcca
